US011920167B2

(12) United States Patent
Vroom et al.

(10) Patent No.: US 11,920,167 B2
(45) Date of Patent: Mar. 5, 2024

(54) ENGINEERED GLYCOSYLTRANSFERASES AND STEVIOL GLYCOSIDE GLUCOSYLATION METHODS

(71) Applicant: TATE & LYLE SOLUTIONS USA LLC, Hoffman Estates, IL (US)

(72) Inventors: Jonathan Vroom, South San Francisco, CA (US); Stephanie Sue Galanie, Knoxville, TN (US); Nikki Dellas, San Carlos, CA (US); Jack Liang, South San Francisco, CA (US); Joyce Liu, Fremont, CA (US); David Entwistle, San Carlos, CA (US); Courtney Dianne Moffett, San Francisco, CA (US)

(73) Assignee: TATE & LYLE SOLUTIONS USA LLC, Hoffman Estates, IL (US)

( * ) Notice: Subject to any disclaimer, the term of this patent is extended or adjusted under 35 U.S.C. 154(b) by 209 days.

(21) Appl. No.: 17/081,932

(22) Filed: Oct. 27, 2020

(65) Prior Publication Data
US 2021/0054349 A1 Feb. 25, 2021

Related U.S. Application Data

(62) Division of application No. 15/886,094, filed on Feb. 1, 2018, now abandoned.

(60) Provisional application No. 62/479,262, filed on Mar. 30, 2017, provisional application No. 62/454,417, filed on Feb. 3, 2017.

(51) Int. Cl.
*C12N 9/88* (2006.01)
*C12N 9/10* (2006.01)
*C12P 19/18* (2006.01)
*C12P 19/56* (2006.01)

(52) U.S. Cl.
CPC ......... *C12N 9/1048* (2013.01); *C12N 9/1051* (2013.01); *C12N 9/88* (2013.01); *C12P 19/18* (2013.01); *C12P 19/56* (2013.01); *C12Y 204/01* (2013.01); *C12Y 204/01013* (2013.01)

(58) Field of Classification Search
CPC ........ C12P 19/56; C12P 19/18; C12N 9/1051; C12N 9/1048; C12N 9/1062; C12N 15/00; A23L 27/36; A23L 2/60; C12Y 204/01; C12Y 204/01013; C12Y 204/00
USPC ........................................................ 435/193
See application file for complete search history.

(56) References Cited

U.S. PATENT DOCUMENTS

| | | |
|---|---|---|
| 4,590,160 A | 5/1986 | Nishihashi et al. |
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |

(Continued)

FOREIGN PATENT DOCUMENTS

| | | |
|---|---|---|
| CN | 103361196 A | 10/2013 |
| CN | 106866757 A | 6/2017 |

(Continued)

OTHER PUBLICATIONS

Davos et al., (Proteins: Structure, Function and Genetics, 2000, vol. 41: 98-107.*
Wristlock et al., (Quarterly Reviews of Biophysics 2003, vol. 36 (3): 307-340.*
Kwiatkowski et al., (Biochemistry 38:11643-11650, 1999.*
Kisselev L., (Structure, 2002, vol. 10: 8-9.*
UniProt Accession No. A0A059ZV61 dated Sep. 29, 2016.

(Continued)

*Primary Examiner* — Robert B Mondesi
*Assistant Examiner* — Mohammad Y Meah
(74) *Attorney, Agent, or Firm* — McDonnell Boehnen Hulbert & Berghoff LLP

(57) ABSTRACT

The present invention provides engineered glycosyltransferase (GT) enzymes, polypeptides having GT activity, and polynucleotides encoding these enzymes, as well as vectors and host cells comprising these polynucleotides and polypeptides. The present invention provides engineered sucrose synthase (SuS) enzymes, polypeptides having SuS activity, and polynucleotides encoding these enzymes, as well as vectors and host cells comprising these polynucleotides and polypeptides. The present invention also provides compositions comprising the GT enzymes and methods of using the engineered GT enzymes to make products with β-glucose linkages. The present invention further provides compositions and methods for the production of rebaudiosides (e.g., rebaudioside M, rebaudioside A, rebaudioside I, and rebaudioside D). The present invention also provides compositions comprising the SuS enzymes and methods of using them. Methods for producing GT and SuS enzymes are also provided.

8 Claims, 3 Drawing Sheets

Specification includes a Sequence Listing.

(56) References Cited

U.S. PATENT DOCUMENTS

| | | |
|---|---|---|
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selifonov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 8,783,566 B1 | 7/2014 | Drew et al. |
| 9,169,285 B2 | 10/2015 | Prakash et al. |
| 9,562,064 B2 | 2/2017 | Markosyan |
| 9,562,251 B2 | 2/2017 | Kishore et al. |
| 9,567,619 B2 | 2/2017 | Mao et al. |
| 9,593,326 B2 | 3/2017 | Clark et al. |
| 9,631,215 B2 | 4/2017 | Houghton-Larsen et al. |
| 9,643,990 B2 | 5/2017 | Mao et al. |
| 9,752,174 B2 | 9/2017 | Markosyan et al. |
| 9,765,104 B2 | 9/2017 | Mao et al. |
| 9,850,270 B2 | 12/2017 | Mao et al. |
| 9,884,120 B2 | 2/2018 | Maymon et al. |
| 9,896,710 B2 | 2/2018 | Kim et al. |
| 9,901,110 B2 | 2/2018 | Markosyan et al. |
| 9,908,913 B2 | 3/2018 | Mao et al. |
| 2006/0195947 A1 | 8/2006 | Davis et al. |
| 2008/0104724 A1 | 5/2008 | Sticklen et al. |
| 2008/0220990 A1 | 9/2008 | Fox |
| 2009/0312196 A1 | 12/2009 | Colbeck et al. |
| 2011/0124587 A1 | 5/2011 | Jackson et al. |
| 2011/0311991 A1 | 12/2011 | Slack et al. |
| 2013/0171328 A1 | 7/2013 | Kishore et al. |
| 2014/0030381 A1 | 1/2014 | Markosyan |
| 2014/0171519 A1 | 6/2014 | Prakash et al. |
| 2014/0272068 A1 | 9/2014 | Prakash et al. |
| 2014/0322389 A1 | 10/2014 | Prakash et al. |
| 2014/0329281 A1 | 11/2014 | Houghton-Larsen et al. |
| 2014/0342043 A1 | 11/2014 | Bell et al. |
| 2014/0342044 A1 | 11/2014 | Bell et al. |
| 2014/0343262 A1 | 11/2014 | Bell et al. |
| 2014/0357588 A1 | 12/2014 | Markosyan et al. |
| 2015/0017284 A1 | 1/2015 | Prakash et al. |
| 2015/0018432 A1 | 1/2015 | Prakash et al. |
| 2015/0031868 A1 | 1/2015 | Lehmann et al. |
| 2015/0050410 A1 | 2/2015 | Luo et al. |
| 2015/0086695 A1 | 3/2015 | Oglesby |
| 2015/0159188 A1 | 6/2015 | Ono et al. |
| 2015/0216218 A1 | 8/2015 | Prakash et al. |
| 2015/0218533 A1 | 8/2015 | Ono |
| 2015/0223505 A1 | 8/2015 | Markosyan |
| 2015/0237898 A1 | 8/2015 | Carlson et al. |
| 2015/0237901 A1 | 8/2015 | Chaturvedula et al. |
| 2015/0327584 A1 | 11/2015 | Shi et al. |
| 2015/0342234 A1 | 12/2015 | Hicks et al. |
| 2015/0344512 A1 | 12/2015 | Prakash et al. |
| 2015/0359251 A1 | 12/2015 | Jackson et al. |
| 2015/0361476 A1 | 12/2015 | Simon et al. |
| 2015/0366253 A1 | 12/2015 | Shi et al. |
| 2016/0010133 A1 | 1/2016 | Park et al. |
| 2016/0015064 A1 | 1/2016 | Luo et al. |
| 2016/0029677 A1 | 2/2016 | Prakash et al. |

(56) References Cited

U.S. PATENT DOCUMENTS

| | | |
|---|---|---|
| 2016/0031924 A9 | 2/2016 | Prakash et al. |
| 2016/0039856 A1 | 2/2016 | Prakash et al. |
| 2016/0153017 A1 | 6/2016 | Van Der Hoeven et al. |
| 2016/0160257 A1 | 6/2016 | Broers et al. |
| 2016/0165941 A1 | 6/2016 | Hofmekler |
| 2016/0185813 A1 | 6/2016 | Galaev |
| 2016/0186225 A1 | 6/2016 | Mikkelsen et al. |
| 2016/0192684 A1 | 7/2016 | Chaturvedula et al. |
| 2016/0198748 A1 | 7/2016 | Prakash et al. |
| 2016/0208225 A1 | 7/2016 | Mao et al. |
| 2016/0235102 A1 | 8/2016 | Oglesby |
| 2016/0251635 A1 | 9/2016 | Mao et al. |
| 2016/0264980 A1 | 9/2016 | Abad et al. |
| 2016/0298159 A1 | 10/2016 | Tao et al. |
| 2016/0316803 A1 | 11/2016 | Markosyan |
| 2017/0002034 A1 | 1/2017 | Prakash et al. |
| 2017/0006906 A1 | 1/2017 | Jackson |
| 2017/0022240 A1 | 1/2017 | Markosyan |
| 2017/0079313 A1 | 3/2017 | Woodyer et al. |
| 2017/0081691 A1 | 4/2017 | Karanewsky et al. |
| 2017/0105432 A1 | 4/2017 | Karanewsky et al. |
| 2017/0112176 A1 | 4/2017 | Markosyan et al. |
| 2017/0172191 A1 | 6/2017 | Prakash et al. |
| 2017/0181443 A1 | 6/2017 | McCormick et al. |
| 2017/0181452 A1 | 6/2017 | Mao et al. |
| 2017/0190728 A1 | 7/2017 | Markosyan |
| 2017/0196248 A1 | 7/2017 | Mao et al. |
| 2017/0211113 A1 | 7/2017 | Tao et al. |
| 2017/0218419 A1 | 8/2017 | Kishore et al. |
| 2017/0218420 A1 | 8/2017 | Mao et al. |
| 2017/0218421 A1 | 8/2017 | Mao et al. |
| 2017/0226145 A1 | 8/2017 | Zhang et al. |
| 2017/0240942 A1 | 8/2017 | Lunde Robertson et al. |
| 2017/0245537 A1 | 8/2017 | Lee et al. |
| 2017/0258120 A1 | 9/2017 | Fotos et al. |
| 2017/0258121 A1 | 9/2017 | Guthrie et al. |
| 2017/0275666 A1 | 9/2017 | Prakash et al. |
| 2017/0295827 A1 | 10/2017 | Prakash et al. |
| 2017/0298404 A1 | 10/2017 | Mao et al. |
| 2017/0298460 A1 | 10/2017 | Markosyan |
| 2017/0303565 A1 | 10/2017 | Markosyan et al. |
| 2017/0303574 A1 | 10/2017 | Luo et al. |
| 2017/0306377 A1 | 10/2017 | Van Den Berg et al. |
| 2017/0321238 A1 | 11/2017 | Houghton-Larsen et al. |
| 2017/0332673 A1 | 11/2017 | Philippe et al. |
| 2017/0352267 A1 | 12/2017 | Tzirkel-Hancock et al. |
| 2017/0354175 A1 | 12/2017 | Karanewsky et al. |
| 2017/0362268 A1 | 12/2017 | Carlson et al. |
| 2018/0002306 A1 | 1/2018 | Jiang et al. |
| 2018/0009835 A1 | 1/2018 | Mao et al. |
| 2018/0020709 A1 | 1/2018 | Markosyan |
| 2018/0037600 A1 | 2/2018 | Mao et al. |
| 2018/0044645 A1 | 2/2018 | Boer et al. |
| 2018/0049455 A1 | 2/2018 | Morita et al. |
| 2018/0051049 A1 | 2/2018 | Mao et al. |
| 2018/0055080 A1 | 3/2018 | Erickson et al. |
| 2018/0057519 A1 | 3/2018 | Mao et al. |
| 2018/0057520 A1 | 3/2018 | Mao et al. |
| 2018/0057521 A1 | 3/2018 | Mao et al. |
| 2018/0057522 A1 | 3/2018 | Mao et al. |
| 2018/0057850 A1 | 3/2018 | Bosch et al. |
| 2018/0073050 A1 | 3/2018 | Boer et al. |
| 2018/0077959 A1 | 3/2018 | Morita et al. |
| 2018/0223264 A1 | 8/2018 | Vroom et al. |

FOREIGN PATENT DOCUMENTS

| | | |
|---|---|---|
| EP | 2 350 110 B1 | 6/2016 |
| JP | 2010-529837 A | 9/2010 |
| JP | 2016-506739 A | 3/2016 |
| KR | 2015-0115002 A | 10/2015 |
| WO | 95/22625 A1 | 8/1995 |
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/152336 A1 | 12/2009 |
| WO | 2013/022989 A2 | 2/2013 |
| WO | 2013/176738 A1 | 11/2013 |
| WO | 2015/065650 A2 | 5/2015 |
| WO | 2016054534 A1 | 4/2016 |
| WO | 2016/073740 A1 | 5/2016 |
| WO | 2016/120486 A1 | 8/2016 |
| WO | 2016/151046 A1 | 9/2016 |
| WO | 2016151046 A1 | 9/2016 |
| WO | 2016/168413 A1 | 10/2016 |
| WO | 2016168413 A1 | 10/2016 |
| WO | 2016/187559 A1 | 11/2016 |
| WO | 2016/196321 A1 | 12/2016 |
| WO | 2016/196345 A1 | 12/2016 |
| WO | 2016/196368 A1 | 12/2016 |
| WO | 2017/000366 A1 | 1/2017 |
| WO | 2017/009293 A1 | 1/2017 |
| WO | 2017/009294 A1 | 1/2017 |
| WO | 2017/024313 A1 | 2/2017 |
| WO | 2017/031424 A1 | 2/2017 |
| WO | 2017/053980 A1 | 3/2017 |
| WO | 2017/059414 A1 | 4/2017 |
| WO | 2017/068017 A1 | 4/2017 |
| WO | 2017/075034 A1 | 5/2017 |
| WO | 2017/093895 A1 | 6/2017 |
| WO | 2017/098017 A1 | 6/2017 |
| WO | 2017/120480 A1 | 7/2017 |
| WO | 2017/151616 A1 | 9/2017 |
| WO | 2017/156432 A1 | 9/2017 |
| WO | 2017/160846 A1 | 9/2017 |
| WO | 2017/170990 A1 | 10/2017 |
| WO | 2017/170998 A1 | 10/2017 |
| WO | 2017/172766 A1 | 10/2017 |
| WO | 2017/176873 A1 | 10/2017 |
| WO | 2017/178632 A1 | 10/2017 |
| WO | 2017/189778 A1 | 11/2017 |
| WO | 2017/189994 A1 | 11/2017 |
| WO | 2017/196933 A1 | 11/2017 |
| WO | 2017/207484 A1 | 12/2017 |
| WO | 2017/218072 A1 | 12/2017 |
| WO | 2018/027157 A1 | 2/2018 |
| WO | 2018/029272 A1 | 2/2018 |
| WO | 2018/029274 A1 | 2/2018 |
| WO | 2018/031955 A1 | 2/2018 |

OTHER PUBLICATIONS

NCBI Accession No. XP_006367681.1 dated Jan. 5, 2016.
European Partial Search Report from EP 21 16 5049 dated Jul. 29, 2021.
European Partial Search Report from EP 21 16 5048 dated Jul. 29, 2021.
Humphrey, T.V., et al., "Spatial organisation of four enzymes from Stevia rebaudiana that are involved in steviol glycoside synthesis," Plant Molecular Biology, 61:47-62 [2006].
Altschul, S., et al., "Basic local alignment search tool," J. Mol. Biol., 215: 403-410 [1990].
Altschul, S.F., et al., "Gapped BLAST and PSI-BLAST: a new generation of protein database search programs," Nucleic Acids Res., 25(17):3389-3402 [1997].
Ameyama, M., et al., "D-Fructose Dehydrogenase of Gluconobacter industrius: Purification, Characterization, and Application to Enzymatic Microdetermination of D-Fructose," J. Bacteriol., 145(2):814-823 [1981].
Ameyama, M., "{4} Enzymic microdetermination of d-glucose, d-fructose, d-gluconate, 2-keto-d-gluconate, aldehyde, and alcohol with membrane-bound dehydrogenases," Meth. Enzymol., 89:20-29 [1982].
Baldino, Jr., F., et al., "High-Resolution in Situ Hybridization Histochemistry," Methods Enzymology, 168:761-777 (1989).
Bolton, E.T., et al., "A General Method for the Iisolation of RNA Complementary to DNA," Proc. Natl. Acad. Sci. USA 48:1390 (1962).

(56) References Cited

OTHER PUBLICATIONS

Botstein, D., et al., "Strategies and applications of in vitro mutagenesis," Science, 229(4719):1193-1201 [1985].
Breslauer, K.J., et al., "Predicting DNA duplex stability from the base sequence," Proc. Natl. Acad. Sci. USA, 83:3746-3750 (1986).
Carter, P., "Site-directed mutagenesis," Biochem. J., 237:1-7 [1986].
Christians, F.C., et al., "Directed evolution of thymidine kinase for AZT phosphorylation using DNA family shuffling," Nat. Biotechnol., 17:259-264 (1999).
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15(5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Diricks, M., et al., "Identification of sucrose synthase in nonphotosynthetic bacteria and characterization of the recombinant enzymes," Appl. Microbiol. Biotechnol., 99(20): 8465-74 [2015].
Batzer, M.A., "Erratum: Structure and variability of recently inserted Alu family members", Nucleic Acids Res 19:698-699 [1991].
Figueroa, C.M., et al., "The unique nucleotide specificity of the sucrose synthase from Thermosynechococcus elongatus," FEBS Lett., 587: 165-9 [2013].
Freier, S.M., et al., "Improved free-energy parameters for predictions of RNA duplex stability," Proc. Natl. Acad. Sci USA, 83:9373-9377 (1986).
Guo, Z., et al., "3'-End-Forming Signals of Yeast mRNA," Mol. Cell. Biol., 15(11):5983-5990 [1995].
Henaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.
Henikoff, S., et al., "Amino acid substitution matrices from protein blocks," Proc. Natl. Acad. Sci., 89:10915-10919 (1992).
Kasai, R., et al., "Sweet Diterpene-Glycosides of Leaves of Stevia rebaudiana Bertoni—Synthesis and Structure—Sweetness Relationship of Rebaudiosides-A,-D,-E and Their Related Glycosides," Nippon Kagaku Kaishi, The Chemical Society, 1981(5):726-735 [1981].
Kierzek, R., et al., "Polymer-Supported RNA Synthesis and Its Application To Test the Nearest-Neighbor Model for Duplex Stability," Biochemistry, 25:7840-7846 (1986).
Kramer, B., et al., "Different base/base mismatches are corrected with different efficiencies by the methyl-directed DNA mismatch-repair system of *E. coli*," Cell, 38(3):879-887, 1984.
Airson, L.L., et al., "Glycosyltransferases: Structures, Functions, and Mechanisms," Ann. Rev. Biochem., 77:521-555 [2008].
Ling, M., et al., "Approaches to DNA Mutagenesis:An Overview," Anal. Biochem., 254:157-78 (1997).
Mcinerney, J.O., "GCUA: general codon usage analysis," Bioinformatics, 14(4):372-73 [1998].
Minshull, J., et al., "Protein evolution by molecular breeding," Curr. Op. Chem. Biol., 3(3):284-290 (1999).
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).

Pearson, W.R., "Improved tools for biological sequence comparison," Proc. Nat'l. Acad. Sci. USA, 85:2444-2448 (1988).
Prakash, I., et al., "Development of Next Generation Stevia Sweetener: Rebaudioside M," Foods, 3:162-175 [2014].
Prakash, I., et al., "Isolation, Characterization and Sensory Evaluation of a Hexa β-D-Glucopyranosyl Diterpene from Stevia rebaudiana," Nat. Prod. Comm., 8(11):1523-6 [2013].
Richman, A., et al., "Functional genomics uncovers three glucosyltransferases involved in the synthesis of the major sweet glucosides of Stevia rebaudiana," Plant J., 41:56-67 [2005].
Romanos, M.A., et al., "Foreign gene expression in yeast: a review," Yeast 8:423-488 [1992].
Rychlik, W., et al., "Optimization of the annealing temperature for DNA amplification in vitro," Nucleic Acids Res, 18(21):6409-6412 (1990).
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Stenico, M., et al., "Codon usage in Caenorhabditis elegans: delineation of translational selection and mutational biases," Nucl. Acids Res. 22(13):2437-46 [1994].
Suggs, S.V., et al., "Use of synthetic oligodeoxyribonucleotides for the isolation of specific cloned DNA sequenes," In Developmental Biology Using Purified Genes (Brown et al., eds.), pp. 683-693, Academic Press (1981).
Tiwari, S., et al., "Prediction of probable genes by Fourier analysis of genomic sequences," Comput. Appl. Biosci. 13(3):263-270 [1997].
Uberbacher, E.C., et al., "Discovering and Understanding Genes in Human DNA Sequence Using GRAIL," Methods Enzymol., 266:259-281 [1996].
Villa-Komaroff, L., et al., "A bacterial clone synthesizing proinsulin," Proc. Natl Acad. Sci. USA, 75:3727-3731 (1978).
Wada, K., et al., "Codon usage tabulated from the GenBank genetic sequence data," Nucl. Acids Res., 20:2111-2118 [1992].
Wells, J.A., et al., "Cassette mutagenesis: an efficient method for generation of multiple mutations at defined sites," Gene, 34:315-323 (1985).
Wetmur, J. G., "DNA Probes: Applications of the Principles of Nucleic Acid Hybridization," Crit Rev Biochem Mol Biol, 26(3/4):227-259 (1991).
Wright, F., "The 'effective number of codons' used in a gene," Gene 87:23-29 [1990].
Zhang, J-H., et al., "Directed evolution of a fucosidase from a galactosidase by DNA shuffling and screening," Proc. Nat. Acad. Sci., U.S.A., 94:4504-4509 (1997).
Kinghorn, D.A., "Stevia: The genus *Stevia*," 2002, Taylor & Francis, London, England and New York, NY, US.
UniProtKB Accession No. R4SD05_STERE dated Jul. 24, 2013 retrieved from http://www.uniprot.org/uniprot/R4SD05.txt on Jun. 6, 2018; p. 1.
Devos, D., et al., "Practical Limits of function Prediction," Proteins: Structure, Function, and Genetics, 41:98-107 [2000].
Wristlock, J.C., et al., "Prediction of protein function from protein sequence and structure," Quarterly Reviews of Biophysics, 36(3):307-340 [2003].
Witkowski, A., et al., "Conversion of a B-Ketoacyl Synthase to a Malonyl Decarboxylase by Replacement of the Active-Site Cysteine with Glutamine," Biochemistry, 38:11643-11650 [1999].
Kisselev, L., "Polypeptide Release Factors in Prokaryotes and Eukaryotes: Same Function, Different Structure," Structure, 10:8-9 [2002].

* cited by examiner

ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088.

ENGINEERED GLYCOSYLTRANSFERASES AND STEVIOL GLYCOSIDE GLUCOSYLATION METHODS

The present application is a Divisional of co-pending U.S. patent application Ser. No. 15/886,094, filed Feb. 1, 2018, now abandoned, which claims priority to U.S. Prov. Pat. Appln. Ser. No. 62/454,417, filed Feb. 3, 2017, and U.S. Prov. Pat. Appln. Ser. No. 62/479,262, filed Mar. 30, 2017, all of which are hereby incorporated by reference in their entireties, for all purposes.

FIELD OF THE INVENTION

The present invention provides engineered glycosyltransferase (GT) enzymes, polypeptides having GT activity, and polynucleotides encoding these enzymes, as well as vectors and host cells comprising these polynucleotides and polypeptides. The present invention provides engineered sucrose synthase (SuS) enzymes, polypeptides having SuS activity, and polynucleotides encoding these enzymes, as well as vectors and host cells comprising these polynucleotides and polypeptides. The present invention also provides compositions comprising the GT enzymes and methods of using the engineered GT enzymes to make products with β-glucose linkages. The present invention further provides compositions and methods for the production of rebaudiosides (e.g., rebaudioside M, rebaudioside A, rebaudioside I, and rebaudioside D). The present invention also provides compositions comprising the SuS enzymes and methods of using them. Methods for producing GT and SuS enzymes are also provided.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX8-162WO3_ST25.txt", a creation date of Jan. 24, 2018, and a size of 31,100 kilobytes. The Sequence Listing filed via EFS-Web is part of the specification and is incorporated in its entirety by reference herein.

BACKGROUND OF THE INVENTION

Glycosyltransferases (GT) are enzymes that post-translationally transfer glycosyl residues from an activated nucleoside sugar to monomeric and polymeric acceptor molecules (e.g., other sugars, proteins, lipids, and other organic substrates). Thus, these enzymes utilize an activated donor sugar substrate that contains a substituted phosphate leaving group. Donor sugar substrates (i.e., the "glycosyl donor") are commonly activated as nucleoside diphosphate sugars. However, other sugars, such as nucleoside monophosphate sugars, lipid phosphates and unsubstituted phosphates are also used (See e.g., Lairson et al., Ann. Rev. Biochem., 77:25.1-25.35 [2008]). GTs are classified as either retaining or inverting enzymes, based on the stereochemistry of the substrates and reaction products. In reactions where the stereochemistry of the donor's anomeric bond is retained (e.g., alpha to alpha), the GT is a retaining enzyme. In reactions where the stereochemistry is inverted (e.g., alpha to beta), the GT is an inverting enzyme. These glycosylated products are involved in various metabolic pathways and processes. Indeed, the biosynthesis of numerous disaccharides, oligosaccharides, and polysaccharides involve the action of various glycosyltransferases. The transfer of a glucosyl moiety can alter the acceptor's bioactivity, solubility, and transport properties within cells. GTs have found use in the targeted synthesis of specific compounds (e.g., glycoconjugates and glycosides), as well as the production of differentially glycosylated drug, biological probes or natural product libraries. In some methods, the large scale use of GTs for glycoconjugate synthesis requires large quantities of glycosyl donors, adding to the cost of such approaches. Nucleotide recycling systems have been developed to allow the resynthesis of glycosyl donors from the released nucleotide. These recycling systems also reduce the amount of nucleotide by-product formed during the reaction, thereby reducing inhibition caused by the GT. Nonetheless, the need remains for improved methods suitable for large-scale production of glycoconjugates by GTs.

SUMMARY OF THE INVENTION

The present invention provides engineered glycosyltransferase (GT) enzymes, polypeptides having GT activity, and polynucleotides encoding these enzymes, as well as vectors and host cells comprising these polynucleotides and polypeptides. The present invention provides engineered sucrose synthase (SuS) enzymes, polypeptides having SuS activity, and polynucleotides encoding these enzymes, as well as vectors and host cells comprising these polynucleotides and polypeptides. The present invention also provides compositions comprising the GT enzymes and methods of using the engineered GT enzymes to make products with β-glucose linkages. The present invention further provides compositions and methods for the production of rebaudiosides (e.g., rebaudioside M, rebaudioside A, rebaudioside I, and rebaudioside D). The present invention also provides compositions comprising the SuS enzymes and methods of using them. Methods for producing GT and SuS enzymes are also provided.

The present invention provides engineered glycosyltransferases comprising polypeptide sequences that have at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO:2. In some embodiments, the engineered glycosyltransferase comprises a polypeptide that has 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 90% sequence identity to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 91% sequence identity to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 92% sequence identity to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 93% sequence identity to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 94% sequence identity to SEQ ID NO: 44, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 95% sequence identity to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 96% sequence identity to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 97% sequence identity to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 98% sequence identity to SEQ ID NO: 44, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide that has at least 99% sequence identity to SEQ ID NO: 44, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase comprises a polypeptide selected from SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some additional embodiments, the engineered glycosyltransferase is selected from beta-1,2-glycosyltransferases and beta-1,3-glycosyltransferases. In some further embodiments, the engineered glycosyltransferase preferentially uses a sugar donor other than uracil-diphosphate. In some additional embodiments, the polypeptide sequence of the engineered glycosyltransferase comprises a variant engineered glycosyltransferase provided in Table 2.1, 3.1, 5.1, 6.1, 6.3, 8.1, 9.1, 9.2, 9.4, 11.1, 12.1, 14.1, 15.1, 15.2, 15.3, 16.1, 17.1, 43.1, 43.2, 44.2, 45.1, 45.3, 46.1, 46.2, 46.3, 47.1, 47.2, 47.3, 48.1, 48.2, 49.1, 49.3, 50.1, 50.2, 50.3, 50.4, 51.1, 51.2, 52.1, 53.1, 53.3, 54.1, 54.2, 54.3, 55.1, 55.2, 55.3, 56.1, 56.2, 56.3, 57.1, 58.1, 58.2, 58.3, 59.1, 59.3, 59.3, 60.1, 60.2, 61.1, 61.2, 62.1, 62.2, 63.1, 63.2, 64.1, 64.2, 65.1, 65.2, 66.1, 66.2, 67.1, 67.2, 67.3, 68.1, 68.2, 69.1, 69.2, 70.1, 70.2, 71.1, 71.2, 71.3, 72.1, 72.2, 72.3, 73.1, 73.2, 74.1, 74.2, 74.3, 75.1, 75.2, 75.3, 77.1, and/or 77.2. The present invention provides engineered glycosyltransferases comprising polypeptide sequences that have at least 90%, 91%, 92%, 93%, 94%, 95%, 96%, 97%, 98%, 99%, or more sequence identity to SEQ ID NOS: 6, 8, 10, 12, 14, 16, 18, 20, 22, 24, 26, 28, 30, 22, 34, 36, 38, 40, 42, 44, 46, 48, 50, 52, 54, 56, 58, 60, 62, 64, 66, 68, 70, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1290, 1292, 1294, 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656, 2658, 2660, 2662, 2664, 2666, 2668, 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, 2774, 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2830, 2932, 2934, 2936, 2938, 2940, 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, 3490, 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, 3652, 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, 3850, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, 3898, 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120, 4122, 4124, 4126, 4128, 4130, 4132, 4134, 4136, 4138, 4140, 4142, 4144, 4146, 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212, 4214, 4216, 4218, 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460, 4462, 4464, 4466, 4468, 4470, 4472, 4474, 4476, 4478, 4480, 4482, 4484, 4486, 4488, 4490, 4492, 4494, 4496, 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4640, 4642, 4644, 4646, 4648, 4650, 4652, 4654, 4656, 4658, 4660, 4662, 4664, 46664668, 4670, 4672, 4674, 4676, 4678, 4680, 4682, 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4902, 4804, 4806, 4808, 4810, 4812, 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, 4874, 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, 5016, 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, 5260, 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, 5342, 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, 5542, 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, 5642, 5644, 5646, 5648, 5650, 5652, 5654, 5656, 5658, 5660, 5662, 5664, 5666, 5668, 5670, 5672, 5674, 5676, 5678, 5680, 5682, 5684, 5686, 5688, 5690, 5692, 5694, 5696, 5698, 5700, 5702, 5704, 5706, 5708, 5710, 5712, 5714, 5716, 5718, 5720, 5722, 5724, 5726, 5728, 5730, 5732, 5734, 5736, 5738, 5740, 5742, 5744, 5746, 5748, 5750, 5752, 5754, 5756, 5758, 5760, 5762, 5764, 5766, 5768, 5770, 5772, 5774, 5776, 5778, 5780, 5782, 5784, 5786, 5788, 5790, 5792, 5794, 5796, 5798, 5800, 5802, 5804, 5806, 5808, 5810, 5812, 5814, 5816, 5818, 5820, 5822, 5824, 5826, 5828, 5830, 5832, 5834, 5836, 5838, 5840, 5842, 5844, 5846, 5848, 5850, 5852, 5854, 5856, 5858, 5860, 5862, 5864, 5866, 5868, 5870, 5872, 5874, 5876, 5878, 5880, 5882, 5884, 5886, 5888, 5890, 5892, 5894, 5896, 5898, 5900, 5902, 5904, 5906, 5908, 5910, 5912, 5914, 5916, 5918, 5920, 5922, 5924, 5926, 5928, 5930, 5932, 5934, 5936, 5938, 5940, 5942, 5944, 5946, 5948, 5950, 5952, 5954, 5956, 5958, 5960, 5962, 5964, 5966, 5968, 5970, 5972, 5974, 5976, 5978, 5980, 5982, 5984, 5986, 5988, 5990, 5992, 5994, 5996, 5998, 6000, 6002, 6004, 6006, 6008, 6010, 6012, 6014, 6016, 6018, 6020, 6022, 6024, 6026, 6028, 6030, 6032, 6034, 6036, 6038, 6040, 6042, 6044, 6046, 6048, 6050, 6052, 6054, 6056, 6058, 6060, 6062, 6064, 6066, 6068, 6070, 6072, 6074, 6076, 6078, 6080, 6082, 6084, 6086, 6088, 6090, 6092, 6094, 6096, 6098, 6100, 6102, 6104, 6106, 6108, 6110, 6112, 6114, 6116, 6118, 6120, 6122, 6124, 6126, 6128, 6130, 6132, 6134, 6136, 6138, 6140, 6142, 6144, 6146, 6148, 6150, 6152, 6154, 6156, 6158, 6160, 6162, 6164, 6166, 6168, 6170, 6172, 6174, 6176, 6178, 6180, 6182, 6184, 6186, 6188, 6190, 6192, 6194, 6196, 6198, 6200, 6202, 6204, 6206, 6208, 6210, 6212, 6214, 6216, 6218, 6220, 6222, 6224, 6226, 6228, 6230, 6232, 6234, 6236, 6238, 6240, 6242, 6244, 6246, 6248, 6250, 6252, 6254, 6256, 6258, 6260, 6262, 6264, 6266, 6268, 6270, 6272, 6274, 6276, 6278, 6280, 6282, 6284, 6286, 6288, 6290, 6292, 6294, 6296, 6298, 6300, 6302, 6304, 6306, 6308, 6310, 6312, 6314, 6316, 6318, 6320, 6322, 6324, 6326, 6328, 6330, 6332, 6334, 6336, 6338, 6340, 6342, 6344, 6346, 6348, 6350, 6352, 6354, 6356, 6358, 6360, 6362, 6364, 6366, 6368, 6370, 6372, 6374, 6376, 6378, 6380, 6382, 6384, 6386, 6388, 6390, 6392, 6394, 6396, 6398, 6400, 6402, 6404, 6406, 6408, 6410, 6412, 6414, 6416, 6418, 6420, 6422, 6424, 6426, 6428, 6430, 6432, 6434, 6436, 6438, 6440, 6442, 6444, 6446, 6448, 6450, 6452, 6454, 6456, 6458, 6460, 6462, 6464, 6466, 6468, 6470, 6472, 6474, 6476, 6478, 6480, 6482, 6484, 6486, 6488, 6490, 6492, 6494, 6496, 6498, 6500, 6502, 6504, 6506, 6508, 6510, 6512, 6514, 6516, 6518, 6520, 6522, 6524, 6526, 6528, 6530, 6532, 6534, 6536, 6538, 6540, 6542, 6544, 6546, 6548, 6550, 6552, 6554, 6556, 6558, 6560, 6562, 6564, 6566, 6568, 6570, 6572, 6574, 6576, 6578, 6580, 6582, 6584, 6586, 6588, 6590, 6592, 6594, 6596, 6598, 6600, 6602, 6604, 6606, 6608, 6610, 6612, 6614, 6616, 6618, 6620, 6622, 6624, 6626, 6628, 6630, 6632, 6634, 6636, 6638, 6640, 6642, 6644, 6646, 6648, 6650, 6652, 6654, 6656, 6658, 6660, 6662, 6664, 6666, 6668, 6670, 6672, 6674, 6676, 6678, 6680, 6682, 6684, 6686, 6688, 6690, 6692, 6694, 6696, 6698, 6700, 6702, 6704, 6706, 6708, 6710, 6712, 6714, 6716, 6718, 6720, 6722, 6724, 6726, 6728, 6730, 6732, 6734, 6736, 6738, 6740, 6742, 6744, 6746, 6748, 6750, 6752, 6754, 6756, 6758, 6760, 6762, 6764, 6766, 6768, 6770, 6772, 6774, 6776, 6778, 6780, 6782, 6784, 6786, 6788, 6790, 6792, 6794, 6796, 6798, 6800, 6802, 6804, 6806, 6808, 6810, 6812, 6814, 6816, 6818, 6820, 6822, 6824, 6826, 6828, 6830, 6832, 6834, 6836, 6838, 6840, 6842, 6844, 6846, 6848, 6850, 6852, 6854, 6856, 6858, 6860, 6862, 6864, 6866, 6868, 6870, 6872, 6874, 6876, 6878, 6880, 6882, 6884, 6886, 6888, 6890, 6892, 6894, 6896, 6898, 6900, 6902, 6904, 6906, 6908, 6910, 6912, 6914, 6916, 6918, 6920, 6922, 6924, 6926, 6928, 6930, 6932, 6934, 6936, 6938, 6940, 6942, 6944, 6946, 6948, 6950, 6952, 6954, 6956, 6958, 6960, 6962, 6964, 6966, 6968, 6970, 6972, 6974, 6976, 6978, 6980, 6982, 6984, 6986, 6988, 6990, 6992, 6994, 6996, 6998, 7000, 7002, 7004, 7006, 7008, 7010, 7012, 7014, 7016, 7018, 7020, 7022, 7024, 7026, 7028, 7030, 7032, 7034, 7036, 7038, 7040, 7042, 7044, 7046, 7048, 7050, 7052, 7054, 7056, 7058, 7060, 7062, 7064, 7066, 7068, 7070, 7072, 7074, 7076, 7078, 7080, 7082, 7084, 7086, 7088, 7090, 7092, 7094, 7096, 7098, 7100, 7102, 7104, 7106, 7108, 7110, 7112, 7114, 7116, 7118, 7120, 7122, 7124, 7126, 7128, 7130, 7132, 7134, 7136, 7138, 7140, 7142, 7144, 7146, 7148, 7150, 7152, 7154, 7156, 7158, 7160, 7162, 7164, 7166, 7168, 7170, 7172, 7174, 7176, 7178, 7180, 7182, 7184, 7186, 7188, 7190, 7192, 7194, 7196, 7198, 7200, 7202, 7204, 7206, 7208, 7210, 7212, 7214, 7216, 7218, 7220, 7222, 7224, 7226, 7228, 7230, 7232, 7234, 7236, 7238, 7240, 7242, 7244, 7246, 7248, 7250, 7252, 7254, 7256, 7258, 7260, 7262, 7264, 7266, 7268, 7270, 7272, 7274, 7276, 7278, 7280, 7282, 7284, 7286, 7288, 7290, 7292, 7294, 7296, 7298, 7300, 7302, 7304, 7306, 7308, 7310, 7312, 7314, 7316, 7318, 7320, 7322, 7324, 7326, 7328, 7330, 7332, 7334, 7336, 7338, 7340, 7342, 7344, 7346, 7348, 7350, 7352, 7354, 7356, 7358, 7360, 7362, 7364, 7366, 7368, 7370, 7372, 7374, 7376, 7378, 7380, 7382, 7384, 7386, 7388, 7390, 7392, 7394, 7396, 7398, 7400, 7402, 7404, 7406, 7408, 7410, 7412, 7414, 7416, 7418, 7420, 7422, 7424, 7426, 7428, 7430, 7432, 7434, 7436, 7766, 7768, 7770, 7772, 7774, 7776, 7778, 7780, 7782, 7784, 7786, 7788, 7790, 7792, 7794, 7796, 7798, 7800, 7812, 7814, 7816, 7818, 7820, 7822, 7824, 7826, 7828, 7830, 7832, 7834, 7836, 7838, 7840, 7842, 7844, 7846, 7848, 7850, 7852, 7854, 7856, 7858, 7860, 7862, 7864, 7866, 7868, 7870, 7872, 7874, 7876, 7878, 7880, 7882, 7884, 7886, 7888, 7890, 7892, 7894, 7896, 7898, 7900, 7902, 7904, 7906, 7908, 7910, 7912, 7914, 7916, 7918, 7920, 7922, 7924, 7926, 7928, 7930, 7932, 7934, 7936, 7938, 7940, 7942, 7944, 7946, 7948, 7950, 7952, 7954, 7956, 7958, 7960, 7962, 7964, 7966, 7968, 7970, 7972, 7974, 7976, 7978, 7980, 7982, 7984, 7986, 7988, 7990, 7992, 7994, 7996, 7998, 8000, 8002, 8004, 8006, 8008, 8010, 8012, 8014, 8016, 8018, 8020, 8022, 8024, 8026, 8028, 8030, 8032, 8034, 8036, 8038, 8040, 8042, 8044, 8046, 8048, 8050, 8052, 8054, 8056, 8058, 8060, 8062, 8064, 8066, 8068, 8070, 8072, 8074, 8076, 8078, 8080, 8082, 8084, 8086, 8088, 8090, 8092, 8094, 8096, 8098, 8100, 8102, 8104, 8106, 8108, 8110, 8112, 8114, 8116, 8118, 8120, 8122, 8124, 8126, 8128, 8130, 8132, 8134, 8136, 8138, 8140, 8142, 8144, 8146, 8148, 8150, 8152, 8154, 8156, 8158, 8160, 8162, 8164, 8166, 8168, 8170, 8172, 8174, 8176, 8178, 8180, 8182, 8184, 8186, 8188, 8190, 8192, 8194, 8196, 8198, 8200, 8202, 8204, 8206, 8208, 8210, 8212, 8214, 8216, 8218, 8220, 8222, 8224, 8226, 8228, 8230, 8232, 8234, 8236, 8238, 8240, 8242, 8244, 8246, 8248, 8250, 8252, 8254, 8256, 8258, 8260, 8262, 8264, 8266, 8268, 8270, 8272, 8274, 8276, 8278, 8280, 8282, 8284, 8286, 8288, 8290, 8292, 8294, 8296, 8298, 8300, 8302, 8304, 8306, 8308, 8310, 8312, 8314, 8316, 8318, 8320, 8322, 8324, 8326, 8328, 8330, 8332, 8334, 8336, 8338, 8340, 8342, 8344, 8346, 8348, 8350, 8352, 8354, 8356, 8358, 8360, 8362, 8364, 8366, 8368, 8482, 8484, 8486, 8488, 8490, 8492, 8494, 8496, 8498, 8500, 8502, 8504, 8506, 8508, 8510, 8512, 8514, 8516, 8518, 8520, 8522, 8524, 8526, 8528, 8530, 8532, 8534, 8536, 8538, 8540, 8542, 8544, 8546, 8548, 8550, 8552, 8554, 8556, 8558, 8560, 8562, 8564, 8566, 8568, 8570, 8572, 8574, 8576, 8578, 8580, 8582, 8584, 8586, 8588, 8590, 8592, 8594, 8596, 8598, 8600, 8602, 8604, 8606, 8608, 8610, 8612, 8614, 8616, 8618, 8620, 8622, 8624, 8626, 8628, 8630, 8632, 8634, 8636, 8638, 8640, 8642, 8644, 8646, 8648, 8650, 8652, 8654, 8656, 8658, 8660, 8662, 8664, 8666, 8668, 8670, 8672, 8674, 8676, 8678, 8680, 8682, 8684, 8686, 8688, 8690, 8692, 8694, 8696, 8698, 8700, 8702, 8704, 8706, 8708, 8710, 8712, 8714, 8716, 8718, 8720, 8722, 8724, 8726, 8728, 8730, 8732, 8734, 8736, 8738, 8740, 8742, 8744, 8746, 8748, 8750, 8752, 8754, 8756, 8758, 8760, 8762, 8764, 8766, 8768, 8770, 8772, 8774, 8776, 8778, 8780, 8782, 8784, 8786, 8788, 8790, 8792, 8794, 8796, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, 9222, 9224, 9226, 9228, 9230, 9232, 9234, 9236, 9238, and/or 9240.

In some further embodiments, the polypeptide sequence of the engineered glycosyltransferase comprises at least one mutation or mutation set at one or more positions selected from 10, 10/309, 262, 278/284/311/339/360, 283, 307, 309, 339/361, 344/361, and 361, wherein the positions are numbered with reference to SEQ ID NO:4. In some embodiments, the polypeptide sequence of the engineered Glycosyltransferase comprises at least one mutation or mutation set selected from 10-/309R, 262K, 262L, 278L/284I/311G/339A/360G, 283T, 307V, 309L/N/R/S, 339A/361G, 344I/361G, and 361G, wherein the positions are numbered with reference to SEQ ID NO:4. In some further embodiments, the polypeptide sequence of the engineered glycosyltransferase comprises at least one mutation or mutation set selected from R10-/V309R, R262K, R262L, Y278L/T284I/R311G/V339A/N360G, S283T, L307V, V309L/N/R/S, V339A/S361G, V344I/S361G, and S361G, wherein the positions are numbered with reference to SEQ ID NO:4. In still some additional embodiments, the polypeptide sequence of the engineered glycosyltransferase comprises a sequence at least 90% identical to any of SEQ ID NOS: 6, 8, 10, 12, 14, 16, 18, 20, 22, 24, 26, 28, and/or 30. In some further embodiments, the polypeptide sequence of the engineered glycosyltransferase comprises a sequence at least identical to any of SEQ ID NOS: 6, 8, 10, 12, 14, 16, 18, 20, 22, 24, 26, 28, and/or 30. In yet some additional embodiments, the polypeptide sequence of the engineered glycosyltransferase comprises SEQ ID NOS: 6, 8, 10, 12, 14, 16, 18, 20, 22, 24, 26, 28, and/or 30.

The present invention also provides engineered glycosyltransferases, wherein the polypeptide sequences of the engineered glycosyltransferases comprise at least one mutation or mutation set at one or more positions selected from 112/172/283/318, 112/261/318, 112/282/283/431, 137/283, 137/283/431, 163/318, 261/283/306/337, 261/283/337, 261/337, 269/318, 282/283, 282/283/431, 283, 283/306/308/360, 283/306/337/426, 283/318/337/360, 283/360, 318, 360, and 431, wherein the positions are numbered with reference to SEQ ID NO:8. In some embodiments, the polypeptide sequence of the engineered glycosyltransferase comprises at least one mutation or mutation set selected from 112S/172S/283Q/318E, 112S/261S/318E, 112S/282T/283Q/431E, 137K/283Q, 137K/283Q/431E, 163K/318E, 261S/283Q/306V/337F, 261S/283Q/337F, 261S/337S, 269T/318E, 282T/283Q, 282T/283Q/431E, 283Q, 283Q/306V/308S/360G, 283Q/306V/337S/426V, 283Q/318E/337S/360G, 283Q/360G, 318E, 360G, and 431E, wherein the positions are numbered with reference to SEQ ID NO:8. In some further embodiments, the polypeptide sequence of the engineered glycosyltransferase comprises at least one mutation or mutation set selected from E112S/T172S/T283Q/T318E, E112S/R261S/T318E, E112S/S282T/T283Q/Q431E, N137K/T283Q, N137K/T283Q/Q431E, L163K/T318E, R261S/T283Q/L306V/W337F, R261S/T283Q/W337F, R261S/W337S, Q269T/T318E, S282T/T283Q, S282T/T283Q/Q431E, T283Q, T283Q/L306V/R308S/S360G, T283Q/L306V/W337S/A426V, T283Q/T318E/W337S/S360G, T283Q/S360G, T318E, S360G, and Q431E, wherein the positions are numbered with reference to SEQ ID NO:8. In some additional embodiments, the polypeptide sequence of the engineered glycosyltransferase comprises a sequence at least 90% identical to any of SEQ ID NOS: 32, 34, 36, 38, 40, 42, 44, 46, 48, 50, 52, 54, 56, 58, 60, 62, 64, 66, 68, and/or 70. In some embodiments, the polypeptide sequence of the engineered glycosyltransferase comprises a sequence at least 95% identical to any of SEQ ID NOS: 32, 34, 36, 38, 40, 42, 44, 46, 48, 50, 52, 54, 56, 58, 60, 62, 64, 66, 68, and/or 70. In some additional embodiments, the polypeptide sequence of the engineered glycosyltransferase comprises SEQ ID NOS: 32, 34, 36, 38, 40, 42, 44, 46, 48, 50, 52, 54, 56, 58, 60, 62, 64, 66, 68, and/or 70.

The present invention also provides engineered glycosyltransferases, wherein the polypeptide sequences of the engineered glycosyltransferases comprise at least one mutation or mutation set at one or more positions selected from 4, 6, 22, 64, 74, 84, 87, 97, 106, 110, 112, 137, 139, 154, 159, 169, 179, 191, 195, 198, 199, 207, 233, 259, 261, 262, 306, 347, 356, 396, 417, 421, 427, and 435, wherein the positions are numbered with reference to SEQ ID NO:32. In yet some additional embodiments, the polypeptide sequence of the engineered glycosyltransferase comprises at least one mutation or mutation set selected from 4P, 6P, 22A/L/H/P, 64P, 74W, 84A/G, 87A/H, 97S, 106D/G/S/T, 110S, 112A/P, 137G, 139P, 154A/L/Q/V, 159M/R, 169T, 179V, 191R, 195G, 198M/S/V, 199A/D/G/K/Q/S, 207L, 233R, 259Q, 261A/H/P/W, 262G, 306V, 347D, 356G, 396R, 417A/R/P, 421V, 427A, and 435Q/R, wherein the positions are numbered with reference to SEQ ID NO:32. In some embodiments, the polypeptide sequence of the engineered glycosyltransferase comprises at least one mutation or mutation set selected from K4P, E6P, Q22A/L/H/P, F64P, R74W, L84A/G, M87A/H, A97S, L106D/G/S/T, A110S, E112A/P, N137G, R139P, H154A/L/Q/V, Q159M/R, D169T, S179V, S191R, N195G, I198M/S/V, L199A/D/G/K/Q/S, I207L, I233R, H259Q, R261A/H/P/W, T262G, L306V, G347D, S356G, Y396R, E417A/R/P, Y421V, R427A, and V435Q/R, wherein the positions are numbered with reference to SEQ ID NO:32.

The present invention also provides engineered glycosyltransferases, wherein the polypeptide sequences of the engineered glycosyltransferases comprise at least one mutation or mutation set at one or more positions selected from 22/84/87/154/198/199/356, 22/84/87/154/198/199/306/356, 22/84/87/154/199/306/356, 22/84/87/154/356, 22/84/87/154/198/199/306/356, 22/84/87/154/199/306/356, 22/84/87/198/199/306/356, 22/84/87/198/199/356, 22/84/87/198/199/306/356, 22/84/87/198/199/356, 22/84/87/199/306/356, 22/84/87/199/356, 22/84/154/198/199/207/306, 22/84/154/198/199/306, 22/84/154/198/199/356, 22/84/154/198/199/356, 22/84/154/198/199/356, 22/84/154/199/356, 22/84/154/199/207, 22/84/154/199/356, 22/84/154/207/306/356, 22/84/154/306/356, 22/84/154/198/199/306/356, 22/84/154/198/199, 22/84/154/198/199/306/356, 22/84/154/199/306/356, 22/84/154/199/356, 22/84/154/199/356, 22/84/198/199/306/356, 22/84/199/356, 22/84/207/356, 22/84/356, 22/84/154/198/199/306/356, 22/87/154/198/199/356, 22/87/154/199/306/356, 22/87/154/322/356, 22/87/154/198/199/356, 22/87/154/199/356, 22/87/154/198/199/207/306/356, 22/87/154/199/207/356, 22/87/154/199/356, 22/87/154/199/306/356, 22/87/198/199/306/356, 22/87/198/199/306/356, 22/87/198/199/207/356, 22/87/198/199/356, 22/87/199/356, 22/87/199/356, 22/154/198/199/207/306/356, 22/154/198/199/356, 22/154/199/356, 22/154/198/199/306/356, 22/154/199/356, 22/154/199/207/306/356, 22/198/199/356, 22/198/199/207/329/356, 22/199/356, 22/207/356, 22/356, and 84/154/198/199, wherein the positions are numbered with reference to SEQ ID NO:32. In some additional embodiments, the polypeptide sequence of the engineered glycosyltransferase comprises at least one mutation or mutation set selected from 22P/84G/87H/154L/198S/199A/356G, 22P/84G/87H/154L/198S/199S/306V/356G, 22P/84G/87H/154L/199K/306V/356G, 22P/84G/87H/154L/356G, 22P/84G/87H/154V/198S/199S/306V/356G, 22P/84G/87H/154V/199K/306V/356G, 22P/84G/87H/198S/199A/306V/356G, 22P/84G/87H/198S/199K/356G, 22P/84G/87H/198S/199S/306V/356G, 22P/84G/87H/198S/199S/356G, 22P/84G/87H/199A/306V/356G, 22P/84G/87H/199S/356G, 22P/84G/154L/198S/199A/207L/306V, 22P/84G/154L/198S/199A/306V, 22P/84G/154L/198S/199A/356G, 22P/84G/154L/198S/199K/356G, 22P/84G/154L/198S/199S/356G, 22P/84G/154L/199A/356G, 22P/84G/154L/199K/207L, 22P/84G/154L/199S/356G, 22P/84G/154L/207L/306V/356G, 22P/84G/154L/306V/356G, 22P/84G/154V/198S/199A/306V/356G, 22P/84G/154V/198S/199K, 22P/84G/154V/198S/199K/306V/356G, 22P/84G/154V/199A/306V/356G, 22P/84G/154V/199A/356G, 22P/84G/154V/199S/356G, 22P/84G/198S/199K/306V/356G, 22P/84G/199S/356G, 22P/84G/207L/356G, 22P/84G/356G, 22P/84V/154V/198S/199S/306V/356G, 22P/87H/154L/198S/199K/356G, 22P/87H/154L/199A/306V/356G, 22P/87H/154L/322S/356G, 22P/87H/154V/198S/199K/356G, 22P/87H/154V/198S/199S/207L/306V/356G, 22P/87H/154V/199A/207L/356G, 22P/87H/154V/199K/356G, 22P/87H/154V/199S/306V/356G, 22P/87H/154V/198S/199A/306V/356G, 22P/87H/198S/199K/306V/356G, 22P/87H/198S/199S/207L/356G, 22P/87H/198S/199K/356G, 22P/87H/199A/356G, 22P/87H/199K/356G, 22P/154L/198S/199A/207L/306V/356G, 22P/154L/198S/199A/356G, 22P/154L/199A/356G, 22P/154V/198S/199S/306V/356G, 22P/154V/199A/356G, 22P/154V/199K/207L/306V/356G, 22P/198S/199A/356G, 22P/198S/199K/207L/329C/356G, 22P/199A/356G, 22P/207L/356G, 22P/356G, and 84G/154L/198S/199K, wherein the positions are numbered with reference to SEQ ID NO:32. In some embodiments, the polypeptide sequence of the engineered glycosyltransferase comprises at least one mutation or mutation set selected from Q22P/L84G/M87H/H154L/I198S/L199A/S356G, Q22P/L84G/M87H/H154L/I198S/L199S/L306V/S356G, Q22P/L84G/M87H/H154L/L199K/L306V/S356G, Q22P/L84G/M87H/H154L/S356G, Q22P/L84G/M87H/H154V/I198S/L199S/L306V/S356G, Q22P/L84G/M87H/H154V/L199K/L306V/S356G, Q22P/L84G/M87H/I198S/L199A/L306V/S356G, Q22P/L84G/M87H/I198S/L199K/S356G, Q22P/L84G/M87H/I198S/L199S/L306V/S356G, Q22P/L84G/M87H/I198S/L199S/S356G, Q22P/L84G/M87H/L199A/L306V/S356G, Q22P/L84G/M87H/L199S/S356G, Q22P/L84G/H154L/I198S/L199A/I207L/L306V, Q22P/L84G/H154L/I198S/L199A/L306V, Q22P/L84G/H154L/I198S/L199A/S356G, Q22P/L84G/H154L/I198S/L199K/S356G, Q22P/L84G/H154L/I198S/L199S/S356G, Q22P/L84G/H154L/L199A/S356G, Q22P/L84G/H154L/L199K/I207L, Q22P/L84G/H154L/L199S/S356G, Q22P/L84G/H154L/I207L/L306V/S356G, Q22P/L84G/H154L/L306V/S356G, Q22P/L84G/H154V/I198S/L199A/L306V/S356G, Q22P/L84G/H154V/I198S/L199K, Q22P/L84G/H154V/I198S/L199K/L306V/S356G, Q22P/L84G/H154V/L199A/L306V/S356G, Q22P/L84G/H154V/L199A/S356G, Q22P/L84G/H154V/L199S/S356G, Q22P/L84G/I198S/L199K/L306V/S356G, Q22P/L84G/L199S/S356G, Q22P/L84G/I207L/S356G, Q22P/L84G/S356G, Q22P/L84V/H154V/I198S/L199S/L306V/S356G, Q22P/M87H/H154L/I198S/L199K/S356G, Q22P/M87H/H154L/L199A/L306V/S356G, Q22P/M87H/H154L/P322S/S356G, Q22P/M87H/H154V/I198S/L199K/S356G, Q22P/M87H/H154V/L199S/S356G, Q22P/M87H/H154V/I198S/L199S/I207L/L306V/S356G, Q22P/M87H/H154V/L199A/I207L/S356G, Q22P/M87H/H154V/L199K/S356G, Q22P/M87H/H154V/L199S/L306V/S356G, Q22P/M87H/I198S/L199A/L306V/S356G, Q22P/M87H/I198S/L199K/L306V/S356G, Q22P/M87H/I198S/L199S/I207L/S356G, Q22P/M87H/I198S/L199K/S356G, Q22P/M87H/L199A/S356G, Q22P/M87H/L199K/S356G, Q22P/H154L/I198S/L199A/I207L/L306V/S356G, Q22P/H154L/I198S/L199A/S356G, Q22P/H154L/L199A/S356G, Q22P/H154V/I198S/L199S/L306V/S356G, Q22P/H154V/L199A/S356G, Q22P/H154V/L199K/I207L/L306V/S356G, Q22P/I198S/L199A/S356G, Q22P/I198S/L199K/I207L/G329C/S356G, Q22P/L199A/S356G, Q22P/I207L/S356G, Q22P/S356G, and L84G/H154L/I198S/L199K, wherein the positions are numbered with reference to SEQ ID NO:32. In some further embodiments, the polypeptide sequence of the engineered glycosyltransferase comprises a sequence at least 90% identical to any of SEQ ID NOS: 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, and 1290. In some further embodiments, the polypeptide sequence of the engineered glycosyltransferase comprises a sequence at least 95% identical to any of SEQ ID NOS: 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, and 1290. In some further embodiments, the polypeptide sequence of the engineered glycosyltransferase comprises any of SEQ ID NOS: 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, and 1290.

The present invention further provides engineered glycosyltransferases, wherein the polypeptide sequences of the engineered glycosyltransferases comprise at least one mutation or mutation set at one or more positions selected from 64/106/109/112/131/159/233/421/427/431, 64/106/109/112/417/421/427/431, 64/106/109/139/179/417/421/427/431, 64/106/109/233/347/427/431, 64/106/112/347/417/421, 64/106/139/179/233/417/427/431, 64/106/417/421, 64/106/431, 64/106/109/112/131/179/417/427/431, 64/106/109/417/421/427/431/439, 64/106/112/139/159/179/204/396/417, 64/106/112/159/179/417/421, 64/106/204/417/421/427, 64/109/112/139/159/179/417/431, 64/109/112/139/417, 64/109/139/233/417/421, 64/109/159/179/204/233/417/421, 64/109/417/421, 64/109/417/421, 64/139/233/417/427/431/439, 64/139/347/417/421/427/431, 64/417/421/431, 106/109/112/131/159/179/417/421, 106/109/112/131/159/204/347/417/421/427, 106/109/112/204/347/421/439, 106/109/112/261/417/431, 106/109/112/347/427, 106/109/139/427/431, 106/109/417/421/427, 106/112/159/204/233/417/421/427/431, 106/112/233/417, 106/112/396/417/421, 106/139/159/233/347/417/421/427/431, 106/233/421/427, 106/417, 106/109/139/347/417/421/427, 106/109, 106/109/139/233/417/421, 106/109/139/417, 106/109/233/427/431, 106/112/159/179/204/417/421, 106/112/159/179/233/417/421/427/439, 106/131/179/233/421/427/431, 106/139/421, 106/347/417/427/431, 109/112/131/159/179/439, 109/112/131/159/417/421, 109/112/139/179/417/427, 109/112/159/179/417/421, 109/112/159/417/427, 109/112/179/204/233/417/421/427, 109/112/179/347/417, 109/112/204/233/417, 109/112/204/427, 109/112/233/417/431, 109/112/417/421/427, 109/112/417/427/431, 109/131/139/179/261/396/421, 109/131/204, 109/139/179/417/421/427, 109/139/179/417/427, 109/179/233/421, 109/204/417/431, 109/417/421, 109/417/427/431, 112/131/179/204/417/421/427, 112/131/179/347/417/421, 112/139/179/204/233/347/427, 112/159/417/421, 112/417/421, 131/179/233/417/427, 139/233/417, 159/347/417/421/431, 179/417/421, 233/417/421/427/431, and 347/417, wherein the positions are numbered with reference to SEQ ID NO:232. In some embodiments, the polypeptide sequence of the engineered glycosyltransferase comprises at least one mutation or mutation set at one or more positions selected from 64P/106S/109R/112P/131P/159R/233R/421V/427L/431D, 64P/106S/109R/112P/417A/421V/427A/431D, 64P/106S/109R/139P/179L/417R/421V/427L/431D, 64P/106S/109R/233R/347D/427A/431D, 64P/106S/112P/347D/417A/421V, 64P/106S/139P/179L/233R/417A/427A/431D, 64P/106S/417R/421V, 64P/106S/431D, 64P/106T/109R/112P/131P/179L/417R/427A/431D, 64P/106T/109R/417A/421V/427L/431D/439P, 64P/106T/112P/139P/159R/179V/204D/396R/417A, 64P/106T/112P/159R/179L/417R/421V, 64P/106T/204D/417A/421V/427A, 64P/109R/112P/139P/159R/179L/417R/431D, 64P/109R/112P/139P/417A, 64P/109R/139P/233R/417R/421V, 64P/109R/159R/179V/204D/233R/417R/421V, 64P/109R/417A/421V, 64P/109R/417R/421V, 64P/139P/233R/417R/427L/431D/439P, 64P/139P/347D/417R/421V/427L/431D, 64P/417R/421V/431D, 106S/109R/112P/131P/159R/179L/417A/421V, 106S/109R/112P/131P/159R/204D/347D/417A/421V/427L, 106S/109R/112P/204D/347D/421V/439P, 106S/109R/112P/261P/417R/431D, 106S/109R/112P/347D/427A, 106S/109R/139P/427A/431D, 106S/109R/417R/421V/427L, 106S/112P/159R/204D/233R/417R/421V/427A/431D, 106S/112P/233R/417R, 106S/112P/396R/417R/421V, 106S/139P/159R/233R/347D/417R/421V/427A/431D, 106S/233R/421V/427A, 106S/417A, 106T/109R/139P/347D/417A/421V/427A, 106T/109R, 106T/109R/139P/233R/417R/421V, 106T/109R/139P/417R, 106T/109R/233R/427A/431D, 106T/112P/159R/179L/204D/417A/421V, 106T/112P/159R/179V/233R/417A/421V/427L/439P, 106T/131P/179L/233R/421V/427L/431D, 106T/139P/421V, 106T/347D/417R/427A/431D, 109R/112P/131P/159R/179V/439P, 109R/112P/131P/159R/417R/421V, 109R/112P/139P/179V/417R/427A, 109R/112P/159R/179V/417R/421V, 109R/112P/159R/417R/427L, 109R/112P/179V/204D/233R/417A/421V/427L, 109R/112P/179V/347D/417R, 109R/112P/204D/233R/417R, 109R/112P/204D/427A, 109R/112P/233R/417A/431D, 109R/112P/417A/421V/427L, 109R/112P/417A/427A/431D, 109R/131P/139P/179V/261P/396R/421V, 109R/131P/204D, 109R/139P/179L/417R/421V/427A, 109R/139P/179L/417R/427L, 109R/179V/233R/421V, 109R/204D/417R/431D, 109R/417R/421V, 109R/417R/427A/431D, 112P/131P/179V/204D/417R/421V/427L, 112P/131P/179L/347D/417R/421V, 112P/139P/179V/204D/233R/347D/427L, 112P/159R/417R/421V, 112P/417R/421V, 131P/179L/233R/417R/427A, 139P/233R/417A, 159R/347D/417A/421V/431D, 179V/417R/421V, 233R/417R/421V/427L/431D, and 347D/417R, wherein the positions are numbered with reference to SEQ ID NO:232. In some embodiments, the polypeptide sequence of the engineered glycosyltransferase comprises at least one mutation or mutation set at one or more positions selected from F64P/L106S/L109R/E112P/S131P/Q159R/I233R/Y421V/R427L/Q431D, F64P/L106S/L109R/E112P/E417A/Y421V/R427A/Q431D, F64P/L106S/L109R/R139P/S179L/E417R/Y421V/R427L/Q431D, F64P/L106S/L109R/I233R/G347D/R427A/Q431D, F64P/L106S/E112P/G347D/E417A/Y421V, F64P/L106S/R139P/S179L/I233R/E417A/R427A/Q431D, F64P/L106S/E417R/Y421V, F64P/L106S/Q431D, F64P/L106T/L109R/E112P/S131P/S179L/

E417R/R427A/Q431D, F64P/L106T/L109R/E417A/ Y421V/R427L/Q431D/K439P, F64P/L106T/E112P/R139P/ Q159R/S179V/G204D/Y396R/E417A, F64P/L106T/ E112P/Q159R/S179L/E417R/Y421V, F64P/L106T/G204D/ E417A/Y421V/R427A, F64P/L109R/E112P/R139P/ Q159R/S179L/E417R/Q431D, F64P/L109R/E112P/R139P/ E417A, F64P/L109R/R139P/I233R/E417R/Y421V, F64P/ L109R/Q159R/S179V/G204D/I233R/E417R/Y421V, F64P/ L109R/E417A/Y421V, F64P/L109R/E417R/Y421V, F64P/ R139P/I233R/E417R/R427L/Q431D/K439P, F64P/R139P/ G347D/E417R/Y421V/R427L/Q431D, F64P/E417R/ Y421V/Q431D, L106S/L109R/E112P/S131P/Q159R/ S179L/E417A/Y421V, L106S/L109R/E112P/S131P/ Q159R/G204D/G347D/E417A/Y421V/R427L, L106S/ L109R/E112P/G204D/G347D/Y421V/K439P, L106S/ L109R/E112P/R261P/E417R/Q431D, L106S/L109R/ E112P/G347D/R427A, L106S/L109R/R139P/R427A/ Q431D, L106S/L109R/E417R/Y421V/R427L, L106S/ E112P/Q159R/G204D/I233R/E417R/Y421V/R427A/ Q431D, L106S/E112P/I233R/E417R, L106S/E112P/ Y396R/E417R/Y421V, L106S/R139P/Q159R/I233R/ G347D/E417R/Y421V/R427A/Q431D, L106S/I233R/ Y421V/R427A, L106S/E417A, L106T/L109R/R139P/ G347D/E417A/Y421V/R427A, L106T/L109R, L106T/ L109R/R139P/I233R/E417R/Y421V, L106T/L109R/ R139P/E417R, L106T/L109R/I233R/R427A/Q431D, L106T/E112P/Q159R/S179L/G204D/E417A/Y421V, L106T/E112P/Q159R/S179V/I233R/E417A/Y421V/ R427L/K439P, L106T/S131P/S179L/I233R/Y421V/ R427L/Q431D, L106T/R139P/Y421V, L106T/G347D/ E417R/R427A/Q431D, L109R/E112P/S131P/Q159R/ S179V/K439P, L109R/E112P/S131P/Q159R/E417R/ Y421V, L109R/E112P/R139P/S179V/E417R/R427A, L109R/E112P/Q159R/S179V/E417R/Y421V, L109R/ E112P/Q159R/E417R/R427L, L109R/E112P/S179V/ G204D/I233R/E417A/Y421V/R427L, L109R/E112P/ S179V/G347D/E417R, L109R/E112P/G204D/I233R/ E417R, L109R/E112P/G204D/R427A, L109R/E112P/ I233R/E417A/Q431D, L109R/E112P/E417A/Y421V/ R427L, L109R/E112P/E417A/R427A/Q431D, L109R/ S131P/R139P/S179V/R261P/Y396R/Y421V, L109R/ S131P/G204D, L109R/R139P/S179L/E417R/Y421V/ R427A, L109R/R139P/S179L/E417R/R427L, L109R/ S179V/I233R/Y421V, L109R/G204D/E417R/Q431D, L109R/E417R/Y421V, L109R/E417R/R427A/Q431D, E112P/S131P/S179V/G204D/E417R/Y421V/R427L, E112P/S131P/S179L/G347D/E417R/Y421V, E112P/ R139P/S179V/G204D/I233R/G347D/R427L, E112P/ Q159R/E417R/Y421V, E112P/E417R/Y421V, S131P/ S179L/I233R/E417R/R427A, R139P/I233R/E417A, Q159R/G347D/E417A/Y421V/Q431D, S179V/E417R/ Y421V, I233R/E417R/Y421V/R427L/Q431D, and G347D/ E417R, wherein the positions are numbered with reference to SEQ ID NO: 232. In some further embodiments, the polypeptide sequence of the engineered glycosyltransferase comprises a sequence at least 90% identical to any of SEQ ID NOS: 348, 350, 352, 354, 356, 358, 360, 362, 364, 366, 368, 370, 372, 374 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, and/or 498. In some embodiments, the polypeptide sequence of the engineered glycosyltransferase comprises a sequence at least 95% identical to any of SEQ ID NOS: 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, and/or 498. In some additional embodiments, the polypeptide sequence of the engineered glycosyltransferase comprises any of SEQ ID NOS: 348, 350, 352, 354, 356, 358, 360, 362, 364, 366, 368, 370, 372, 374 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, and/or 498.

The present invention further provides engineered glycosyltransferases, wherein the polypeptide sequences of the engineered glycosyltransferases comprise at least one mutation or mutation set at one or more positions selected from 106/112/204/347/396/417, 106/112/204/347/396/417/427, 106/112/204/347/396/417/427/431, 112/204/347/396/417/ 427, 112/204/347/396/417/427/431, and 204/347/396/417/ 431, wherein the positions are numbered with reference to SEQ ID NO:348. In some additional embodiments, the polypeptide sequence of the engineered glycosyltransferase comprises at least one mutation or mutation set at one or more positions selected from 106S/112P/204D/347D/396Y/ 417R, 106S/112P/204D/347D/396Y/417R/427A, 106S/ 112P/204D/347D/396Y/417R/427A/431D, 112P/204D/ 347D/396Y/417R/427A, 112P/204D/347D/396Y/417R/ 427A/431D, and 204D/347D/396Y/417R/431D, wherein the positions are numbered with reference to SEQ ID NO:348. In some embodiments, the polypeptide sequence of the engineered glycosyltransferase comprises at least one mutation or mutation set at one or more positions selected from L106S/E112P/G204D/G347D/R396Y/E417R, L106S/ E112P/G204D/G347D/R396Y/E417R/R427A, L106S/ E112P/G204D/G347D/R396Y/E417R/R427A/Q431D, E112P/G204D/G347D/R396Y/E417R/R427A, E112P/ G204D/G347D/R396Y/E417R/R427A/Q431D, and G204D/G347D/R396Y/E417R/Q431D, wherein the positions are numbered with reference to SEQ ID NO:348. In some embodiments, the polypeptide sequence of the engineered glycosyltransferase comprises a sequence at least 90% identical to any of SEQ ID NOS: 500, 502, 504, 506, 508, and/or 510. In some further embodiments, the polypeptide sequence of the engineered glycosyltransferase comprises a sequence at least 95% identical to any of SEQ ID NOS: 500, 502, 504, 506, 508, and/or 510. In some embodiments, the polypeptide sequence of the engineered glycosyltransferase comprises SEQ ID NOS: 500, 502, 504, 506, 508, and/or 510.

The present invention also provides engineered glycosyltransferases, wherein the polypeptide sequences of the engineered glycosyltransferases comprise at least one mutation or mutation set at one or more positions selected from 14/100, 28/44/365/407, 38/118/290/351/375/401/422, 38/178/401, 38/290/351/401/422, 54/413, 74/102/137/161/ 259/289, 92/118, 98/233, 102/161/250/435, 110/222/250/ 259/435, 118/156/178/290/375/401/422, 137/161/435, 137/ 169, 159/169/173/300/424/438, 185/290/401/422, 290/351/ 401, and 435/438, wherein the positions are numbered with reference to SEQ ID NO:348. In some embodiments, the polypeptide sequence of the engineered glycosyltransferase comprises at least one mutation or mutation set at one or more positions selected from 14V/100F, 28M/44V/365I/ 407E, 38R/118A/290E/351G/375P/401L/422M, 38R/178V/ 401L, 38R/290E/351G/401L/422M, 54P/413L, 74W/102K/

137G/161L/259S/289S, 92L/118A, 98P/233W, 102K/161L/ 250A/435E, 110G/222R/250R/259P/435G, 118A/156A/ 178V/290E/375P/401L/422M, 137G/161L/435R, 137G/ 169G, 159M/169S/173G/300Q/424E/438A, 185R/290E/ 401L/422M, 290E/351G/401L, and 435Q/438A, wherein the positions are numbered with reference to SEQ ID NO:348. In some embodiments, the polypeptide sequence of the engineered glycosyltransferase comprises at least one mutation or mutation set at one or more positions selected from I14V/L100F, I28M/I44V/V365I/A407E, K38R/ S118A/D290E/A351G/D375P/W401L/I422M, K38R/ A178V/W401L, K38R/D290E/A351G/W401L/I422M, T54P/V413L, R74W/R102K/N137G/D161L/H259S/ K289S, I92L/S118A, D98P/I233W, R102K/D161L/T250A/ V435E, A110G/K222R/T250R/H259P/V435G, S118A/ S156A/A178V/D290E/D375P/W401L/I422M, N137G/ D161L/V435R, N137G/D169G, Q159M/D169S/R173G/ D300Q/Q424E/M438A, K185R/D290E/W401L/I422M, D290E/A351G/W401L, and V435Q/M438A, wherein the positions are numbered with reference to SEQ ID NO:348. In some embodiments, the polypeptide sequence of the engineered glycosyltransferase comprises a sequence at least 90% identical to any of SEQ ID NOS: 500, 502, 504, 506, 508, 510, 512, 514, 516, 518, 520, 222, 524, 526, 528, 530, 532, 534, 536, 538, 540, 542, 544, 546, and/or 548. In some embodiments, the polypeptide sequence of the engineered glycosyltransferase comprises a sequence at least 95% identical to any of SEQ ID NOS: 500, 502, 504, 506, 508, 510, 512, 514, 516, 518, 520, 222, 524, 526, 528, 530, 532, 534, 536, 538, 540, 542, 544, 546, and/or 548. In some further embodiments, the polypeptide sequences of the engineered glycosyltransferases comprise any of SEQ ID NOS: 500, 502, 504, 506, 508, 510, 512, 514, 516, 518, 520, 222, 524, 526, 528, 530, 532, 534, 536, 538, 540, 542, 544, 546, and/or 548.

The present invention also provides engineered glycosyltransferases, wherein the polypeptide sequence of the engineered glycosyltransferases comprise at least one mutation or mutation set at one or more positions selected from 14/28/38/74/100/102/118/161/169/178/233/250/407/422/ 438, 14/28/38/74/102/156/159/233/250/289/413/422/424/ 435/438, 14/28/38/100/102/110/159/161/233/259/290/300/ 351/435, 14/28/38/110/137/161/222/289/401, 14/28/44/74/ 98/102/137/159/161/185/222/250, 14/28/44/92, 14/28/44/ 161/169, 14/28/44/375, 14/28/54/161/185/413, 14/28/54/ 365, 14/28/74/98/100/102/161/173/178/233/250/259/290/ 407, 14/28/92/100/102/159/161/169/233, 14/28/92/100/ 102/159/161/233/351/422, 14/28/92/100/102/422/424/435, 14/28/92/100/161/222/233/289/300, 14/28/100/137/156/ 161/222/259/289/365/401/435/438, 14/28/100/156/161/ 250, 14/28/102/118/137/161/185/222/250/259/401, 14/28/ 159/289/290/300, 14/28/159/365/435, 14/28/35, 14/38/74/ 110/156/161/173/178/222/300, 14/38/100/102/161/173/ 178/222/250/375/401/413, 44/74/100/102/161/233/365/ 435/438, 14/74/110/159/161/169/173/250/259/290/375/ 407/422, 14/74/161/375/401, 14/92/98/100/159/161/259/ 365/422/424/435, 14/110/156/161/375/401/435/438, 14/159/161/365/435/438, 14/161/222/250/259/289/375/ 401/413, 14/161/222/250/435/438, 14/161/300, 28, 28/38/ 92/98/100/102/156/161, 28/44/74/401, 28/44/92/161/222/ 300/413, 28/44/98/100/102/118, 28/44/118/156/161/222/ 289/435/M438, 28/44/289/290/351/422, 28/44/435/438, 28/54/92/159/161/290, 28/54/159/290/438, 28/54/250/439, 28/74/156/159/161/178/300/365/435/438, 28/74/156/161/ 365/407, 28/74/161/290/365, 28/92/100/102/110/161/185/ 250/300/375/435, 28/92/98/100/110/156/161/401, 28/92/ 118/159/222/250/259/300/407, 28/156/161/185/435/438, 28/156/161/233/259/300/435, 28/98/100/102/161/185/351/ 401/435/438, 38/161/300/438, 74/98/100/102/110/118/161/ 178/250/289/290/300/435/438, 74/98/100/102/118/156/ 159/161/435/438, 74/156/161/173/178/424/435, 74/375/ 435, 98/100/118/159/161/300, 98/100/156/159/161/178/ 259/289/290/351/422, 102/137/159/161/422/424, 118, 137/ 159/161/185/300/351/365/435, 156/159/161/169, 159/161/ 222/290/375/407, 159/161/401, and 161/259/289/435/438, wherein the positions are numbered with reference to SEQ ID NO:548. In some embodiments, the polypeptide sequence of the engineered glycosyltransferase comprises at least one mutation or mutation set at one or more positions selected from 14V/28M/38R/74/100F/102K/118A/161L/ 169G/178V/233W/250R/407E/422M/438A, 14V/28M/ 38R/74W/102K/156A/159M/233W/250A/289S/413L/ 422M/424E/435R/438A, 14V/28M/38R/100F/102K/110G/ 159M/161L/233W/259S/290E/300Q/351G/435Q, 14V/ 28M/38R/110G/137G/161L/222R/289S/401L, 14V/28M/ 44V/74W/98P/102K/137G/159M/161L/185R/222R/250A, 14V/28M/44V/92L, 14V/28M/44V/161L/169S, 14V/28M/ 44V/375P, 14V/28M/54P/161L/185R/413L, 14V/28M/54P/ 365I, 14V/28M/74W/98P/100F/102K/161L/173G/178V/ 233W/250A/259S/290E/407E, 14V/28M/92L/100F/102K/ 159M/161L/169S/233W, 14V/28M/92L/100F/102K/159M/ 161L/233W/351G/422M, 14V/28M/92L/100F/102K/ 422M/424E/435Q, 14V/28M/92L/100F/161L/222R/233W/ 289S/300Q, 14V/28M/100F/137G/156A/161L/222R/259S/ 289S/365I/401L/435R/438A, 14V/28M/100F/156A/161L/ 250R, 14V/28M/102K/118A/137G/161L/185R/222R/250R/ 259P/401L, 14V/28M/159M/289S/290E/300Q, 14V/28M/ 159M/365I/435Q, 14V/28M/351G, 14V/38R/74W/110G/ 156A/161L/173G/178V/222R/300Q, 14V/38R/100F/102K/ 161L/173G/178V/222R/250R/375P/401L/413L, 44V/74W/ 100F/102K/161L/I33W/365I/435G/438A, 14V/74W/110G/ 159M/161L/169G/173G/250A/259P/290E/375P/407E/ 422M, 14V/74W/161L/375P/401L, 14V/92L/98P/100F/ 159M/161L/259P/365I/422M/424E/435R, 14V/110G/ 156A/161L/375P/401L/435EM438A, 14V/159M/161L/ 365I/435E/438A, 14V/161L/222R/250R/259S/289S/375P/ 401L/413L, 14V/161L/222R/250R/435Q/438A, 14V/161L/ 300Q, 28M, 28M/38R/92L/98P/100F/102K/156A/161L, 28M/44V/74W/401L, 28M/44V/92L/161L/222R/300Q/ 413L, 28M/44V/98P/100F/102K/118A, 28M/44V/118A/ 156A/161L/222R/289S/435Q/438A, 28M/44V/289S/290E/ 351G/422M, 28M/44V/435R/438A, 28M/54P/92L/159M/ 161L/290E, 28M/54P/159M/290E/438A, 28M/54P/250R/ 439N 28M/74W/156A/159M/161L/178V/300Q/365I/435Q/ 438A, 28M/74W/156A/161L/365I/407E, 28M/74W/161L/ 290E/365I, 28M/92L/98P/100F/110G/156A/161L/401L, 28M/92L/100F/102K/110G/161L/185R/250A/300Q/375P/ 435Q, 28M/92L/118A/159M/222R/250R/259P/300Q/407E, 28M/98P/100F/102K/161L/185R/351G/401L/435E/438A, 28M/156A/161L/185R/435R/438A, 28M/156A/161L/ 233W/259S/300Q/435R, 38R/161L/300Q/438A, 74W/98P/ 100F/102K/110G/118A/161L/178V/250R/289S/290E/ 300Q/435E/438A, 74W/98P/100F/102K/118A/156A/ 159M/161L/435E/438A, 74W/156A/161L/173G/178V/ 424E/435E, 74W/375P/435G, 98P/100F/118A/159M/161L/ 300Q, 98P/100F/156A/159M/161L/178V/259S/289S/290E/ 351G/422M, 102K/137G/159M/161L/422M/424E, 118A, 137G/159M/161L/185R/300Q/351G/365I/435Q, 156A/ 159M/161L/169S, 159M/161L/222R/290E/375P/407E, 159M/161L/401L, and 161L/259S/289S/435R/438A, wherein the positions are numbered with reference to SEQ ID NO:548.

In some embodiments, the polypeptide sequence of the engineered glycosyltransferase comprises at least one mutation or mutation set at one or more positions selected from I14V/I28M/K38R/R74W/L100F/R102K/S118A/D161L/ D169G/A178V/I233W/T250R/A407E/I422M/M438A, I14V/I28M/K38R/R74W/R102K/S156A/Q159M/I233W/ T250A/K289S/V413L/I422M/Q424E/V435R/M438A, I14V/I28M/K38R/L100F/R102K/A110G/Q159M/D161L/ I233W/H259S/D290E/D300Q/A351G/V435Q, I14V/I28M/ K38R/A110G/N137G/D161L/K222R/K289S/W401L, I14V/I28M/I44V/R74W/D98P/R102K/N137G/Q159M/ D161L/K185R/K222R/T250A, I14V/I28M/I44V/I92L, I14V/I28M/I44V/D161L/D169S, I14V/I28M/I44V/D375P, I14V/I28M/T54P/D161L/K185R/V413L, I14V/I28M/ T54P/V365I, I14V/I28M/R74W/D98P/L100F/R102K/ D161L/R173G/A178V/I233W/T250A/H259S/D290E/ A407E, I14V/I28M/I92L/L100F/R102K/Q159M/D161L/ D169S/I233W, I14V/I28M/I92L/L100F/R102K/Q159M/ D161L/I233W/A351G/I422M, I14V/I28M/I92L/L100F/ R102K/I422M/Q424E/V435Q, I14V/I28M/I92L/L100F/ D161L/K222R/I233W/K289S/D300Q, I14V/I28M/L100F/ N137G/S156A/D161L/K222R/H259S/K289S/V365I/ W401L/V435R/M438A, I14V/I28M/L100F/S156A/ D161L/T250R, I14V/I28M/R102K/S118A/N137G/D161L/ K185R/K222R/T250R/H259P/W401L, I14V/I28M/ Q159M/K289S/D290E/D300Q, I14V/I28M/Q159M/ V365I/V435Q, I14V/I28M/A351G, I14V/K38R/R74W/ A110G/S156A/D161L/R173G/A178V/K222R/D300Q, I14V/K38R/L100F/R102K/D161L/R173G/A178V/K222R/ T250R/D375P/W401L/V413L, I44V/R74W/L100F/ R102K/D161L/I233W/V365I/V435G/M438A, I14V/ R74W/A110G/Q159M/D161L/D169G/R173G/T250A/ H259P/D290E/D375P/A407E/I422M, I14V/R74W/D161L/ D375P/W401L, I14V/I92L/D98P/L100F/Q159M/D161L/ H259P/V365I/I422M/Q424E/V435R, I14V/A110G/S156A/ D161L/D375P/W401L/V435E/M438A, I14V/Q159M/ D161L/V365I/V435E/M438A, I14V/D161L/K222R/ T250R/H259S/K289S/D375P/W401L/V413L, I14V/ D161L/K222R/T250R/V435Q/M438A, I14V/D161L/ D300Q, I28M, I28M/K38R/I92L/D98P/L100F/R102K/ S156A/D161L, I28M/I44V/R74W/W401L, I28M/I44V/ I92L/D161L/K222R/D300Q/V413L, I28M/I44V/D98P/ L100F/R102K/S118A, I28M/I44V/S118A/S156A/D161L/ K222R/K289S/V435Q/M438A, I28M/I44V/K289S/ D290E/A351G/I422M, I28M/I44V/V435R/M438A, I28M/ T54P/I92L/Q159M/D161L/D290E, I28M/T54P/Q159M/ D290E/M438A, I28M/T54P/T250R/K439N, I28M/R74W/ S156A/Q159M/D161L/A178V/D300Q/V365I/V435Q/ M438A, I28M/R74W/S156A/D161L/V365I/A407E, I28M/ R74W/D161L/D290E/V365I, I28M/D98P/L100F/R102K/ D161L/K185R/A351G/W401L/V435E/M438A, I28M/ I92L/L100F/R102K/A110G/D161L/K185R/T250A/D300Q/ D375P/V435Q, I28M/I92L/S118A/Q159M/K222R/T250R/ H259P/D300Q/A407E, I28M/S156A/D161L/K185R/ V435R/M438A, I28M/S156A/D161L/I233W/H259S/ D300Q/V435R, I28M/I92L/D98P/L100F/A110G/S156A/ D161L/W401L, K38R/D161L/D300Q/M438A, R74W/ D98P/L100F/R102K/A110G/S118A/D161L/A178V/ T250R/K289S/D290E/D300Q/V435E/M 438A, R74W/ D98P/L100F/R102K/S118A/S156A/Q159M/D161L/ V435E/M438A, R74W/S156A/D161L/R173G/A178V/ Q424E/V435E, R74W/D375P/V435G, D98P/L100F/ S118A/Q159M/D161L/D300Q, D98P/L100F/S156A/ Q159M/D161L/A178V/H259S/K289S/D290E/A351G/ I422M, R102K/N137G/Q159M/D161L/I422M/Q424E, S118A, N137G/Q159M/D161L/K185R/D300Q/A351G/ V365I/V435Q, S156A/Q159M/D161L/D169S, Q159M/ D161L/K222R/D290E/D375P/A407E, Q159M/D161L/ W401L, and D161L/H259S/K289S/V435R/M438A, wherein the positions are numbered with reference to SEQ ID NO:548. In some embodiments, the polypeptide sequence of the engineered glycosyltransferase comprises a sequence at least 90% identical to any of SEQ ID NOS: 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, and 680, wherein the positions are numbered with reference to SEQ ID NO: 548. In some embodiments, the polypeptide sequence of the engineered glycosyltransferase comprises a sequence at least 95% identical to any of SEQ ID NOS: 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, and 680, wherein the positions are numbered with reference to SEQ ID NO: 548.

In some embodiments, the polypeptide sequence of the engineered glycosyltransferase comprises a sequence any of SEQ ID NOS: 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, and 680, wherein the positions are numbered with reference to SEQ ID NO: 548.

The present invention also provides engineered glycosyltransferases, wherein the polypeptide sequences of the engineered glycosyltransferases comprise at least one mutation or mutation set at one or more positions selected from 19/44/110/191/198/199/208/300/365, 19/75/76/87/92/199/ 207/208, 19/87/92/191/199/209/413/435, 44/76/197/199/ 208/351, 44/87/92/137/159/199/209, 44/87/137/159/169/ 191/199/208, 44/87/137/191/197/209/289/401, 44/87/199/ 208, 75/76/87/92, 75/76/87/92/290/300, 75/76/87/191, 75/76/87/191/197/199/209/300, 75/87/92/169/207/208/300/ 413/435, 75/87/110/137/169/191/199/208/209/289/435, 75/87/110/191/197/198/207/208/289/290/300/401/413, 75/87/300, 75/110/197/199/208/290/300/401/413, 76/92/ 199/209, 87/92/197/198/199/208/300, 87/137/435, 87/169/ 191/199/207/209/401/413, 87/191/198/199/222/244/289/ 300/435, 87/92/110/169/199/207/209/290/300, 87/92/159/ 169/191/198/290/413/435, 87/92/159/191/199/208/209/ 289/290, 87/92/208/401, 87/435, 92/137/191/199/209, 92/197/199/207/208/401, 137/198/199/207/208/426/435, 137/199/208/209/290/435, 137/365, 159/197/199/207/209, 169/191/197/199/207/208, 169/197/199/207/209/222/300/ 413/435, 191/207/208/289/290/413/435, and 197/198/199/ 208/209, wherein the positions are numbered with reference to SEQ ID NO:562. In some embodiments, the polypeptide sequence of the engineered glycosyltransferase comprises at least one mutation or mutation set at one or more positions selected from 19L/44V/110G/191R/198M/199K/208A/ 300Q/365I, 19L/75L/76R/87W/92L/199K/207L/208A, 19L/87W/92L/191R/199K/209G/413L/435Q, 44V/76R/ 197R/199K/208D/351G, 44V/87W/92L/137G/159M/199K/ 209G, 44V/87W/137G/159M/169S/191R/199K/208D, 44V/87W/137G/191R/197R/209G/289S/401L, 44V/87W/ 199K/208A, 75L/76R/87W/92L, 75L/76R/87W/92L/290E/ 300Q, 75L/76R/87W/191R, 75L/76R/87W/191R/197R/ 199K/209G/300Q, 75L/87W/92L/169S/207L/208A/300Q/ 413L/435Q, 75L/87W/110G/137G/169S/191R/199K/208A/ 209G/289S/435Q, 75L/87W/110G/191R/197R/198M/

207L/208D/289S/290E/300Q/401L/413L, 75L/87W/300Q, 75L/110G/197R/199K/208A/290E/300Q/401L/413L, 76R/ 92L/199K/209G, 87L/92L/197R/198M/199K/208D/300Q, 87W/137G/435R, 87W/169S/191R/199K/207L/209G/ 401L/413L, 87W/191R/198M/199K/222R/244L/289S/ 300Q/435R, 87W/92L/110G/169S/199K/207L/209G/290E/ 300Q, 87W/92L/159M/169S/191R/198M/290E/413L/ 435Q, 87W/92L/159M/191R/199K/208A/209G/289S/ 290E, 87W/92L/208A/401L, 87W/435R, 92L/137G/191R/ 199K/209G, 92L/197R/199K/207L/208D/401L, 137G/ 198M/199K/207L/208D/426V/435R, 137G/199K/208A/ 209G/290E/435R, 137G/365I, 159M/197R/199K/207L/ 209G, 169S/191R/197R/199K/207L/208D, 169S/197R/ 199K/207L/209G/222R/300Q/413L/435R, 191R/207L/ 208A/289S/290E/413L/435Q, and 197R/198M/199K/ 208D/209G, wherein the positions are numbered with reference to SEQ ID NO:562. In some embodiments, the polypeptide sequence of the engineered glycosyltransferase comprises at least one mutation or mutation set at one or more positions selected from V19L/I44V/A110G/S191R/ I198M/A199K/K208A/D300Q/V365I, V19L/I75L/S76R/ M87W/I92L/A199K/I207L/K208A, V19L/M87W/I92L/ S191R/A199K/Q209G/V413L/V435Q, I44V/S76R/Q197R/ A199K/K208D/A351G, I44V/M87W/I92L/N137G/ Q159M/A199K/Q209G, I44V/M87W/N137G/Q159M/ G169S/S191R/A199K/K208D, I44V/M87W/N137G/ S191R/Q197R/Q209G/K289S/W401L, I44V/M87W/ A199K/K208A, I75L/S76R/M87W/I92L, I75L/S76R/ M87W/I92L/D290E/D300Q, I75L/S76R/M87W/S191R, I75L/S76R/M87W/S191R/Q197R/A199K/Q209G/D300Q, I75L/M87W/I92L/G169S/I207L/K208A/D300Q/V413L/ V435Q, I75L/M87W/A110G/N137G/G169S/S191R/ A199K/K208A/Q209G/K289S/V435Q, I75L/M87W/ A110G/S191R/Q197R/I198M/I207L/K208D/K289S/ D290E/D300Q/W401L/V41 L, I75L/M87W/D300Q, I75L/ A110G/Q197R/A199K/K208A/D290E/D300Q/W401L/ V413L, S76R/I92L/A199K/Q209G, M87L/I92L/Q197R/ I198M/A199K/K208D/D300Q, M87W/N137G/V435R, M87W/G169S/S191R/A199K/I207L/Q209G/W401L/ V413L, M87W/S191R/I198M/A199K/K222R/P244L/ K289S/D300Q/V435R, M87W/I92L/A110G/G169S/ A199K/I207L/Q209G/D290E/D300Q, M87W/I92L/ Q159M/G169S/S191R/I198M/D290E/V413L/V435Q, M87W/I92L/Q159M/S191R/A199K/K208A/Q209G/ K289S/D290E, M87W/I92L/K208A/W401L, M87W/ V435R, I92L/N137G/S191R/A199K/Q209G, I92L/Q197R/ A199K/I207L/K208D/W401L, N137G/I198M/A199K/ I207L/K208D/A426V/V435R, N137G/A199K/K208A/ Q209G/D290E/V435R, N137G/V365I, Q159M/Q197R/ A199K/I207L/Q209G, G169S/S191R/Q197R/A199K/ I207L/K208D, G169S/Q197R/A199K/I207L/Q209G/ K222R/D300Q/V413L/V435R, S191R/I207L/K208A/ K289S/D290E/V413L/V435Q, and Q197R/I198M/A199K/ K208D/Q209G, wherein the positions are numbered with reference to SEQ ID NO:562. In some embodiments, the polypeptide sequence of the engineered glycosyltransferase comprises a sequence at least 90% identical to any of SEQ ID NOS: 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, and/or 754. In some further embodiments, the polypeptide sequence of the engineered glycosyltransferase comprises a sequence at least 95% identical to any of SEQ ID NOS: 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, and/or 754. In some embodiments, the polypeptide sequence of the engineered glycosyltransferase comprises SEQ ID NOS: 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, and/or 754.

The present invention also provides engineered glycosyltransferases, wherein the polypeptide sequences of the engineered glycosyltransferases comprise at least one mutation or mutation set at one or more positions selected from 22, 25, 51, 56, 71, 78, 80, 81, 88, 157, 185/208/230/252/255/ 290/365, 189/206/208/365, 200, 208/365/435, 243, 245, 249, 259, 262/401, 279, 282, 284, 304/322/365/401, 308, 338, 339, 352, 362, 364, 365/401/413/435, 366, and 374, wherein the positions are numbered with reference to SEQ ID NO:696. In some embodiments, the polypeptide sequence of the engineered glycosyltransferase comprises at least one mutation or mutation set at one or more positions selected from 22L, 25L, 25V, 51A, 56L, 71R, 78E, 78F, 78G, 78I, 78K, 78M, 78P, 78Q, 78R, 80L, 81C, 88I, 88K, 88V, 157G, 157Q, 185R/208A/230S/252N/255N/290E/ 365I, 189L/206K/208A/365I, 200N, 200S, 208A/365I/ 435Q, 243C, 243L, 243M, 243V, 243Y, 245G, 249E, 249H, 249I, 249M, 249N, 249P, 249S, 249T, 249Y, 259G, 259, 259Y, 262S/401L, 279G, 282T, 284T, 304P/322S/365I/ 401L, 308F, 308Y, 338C, 339D, 352Q, 362T, 364G, 365I/ 401L/413L/435Q, 366A, and 374T, wherein the positions are numbered with reference to SEQ ID NO:696. In some additional embodiments, the polypeptide sequence of the engineered glycosyltransferase comprises at least one mutation or mutation set at one or more positions selected from P22L, I25L, I25V, K51A, N56L, Q71R, L78E, L78F, L78G, L78I, L78K, L78M, L78P, L78Q, L78R, T80L, H81C, R88I, R88K, R88V, L157G, L157Q, K185R/K208A/E230S/ S252N/S255N/D290E/V365I, I189L/M206K/K208A/ V365I, K200N, K200S, K208A/V365I/V435Q, I243C, I243L, I243M, I243V, I243Y, L245G, L249E, L249H, L249I, L249M, L249N, L249P, L249S, L249T, L249Y, H259G, H259S, H259Y, T262S/W401L, S279G, S282T, S284T, S304P/P322S/V365I/W401L, R308F, R308Y, V338C, P339D, F352Q, L362T, S364G, V365I/W401L/ V413L/V435Q, C366A, and S374T, wherein the positions are numbered with reference to SEQ ID NO:696. In some embodiments, the polypeptide sequence of the engineered glycosyltransferase comprises a sequence at least 90% identical to any of SEQ ID NOS: 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4902, 4804, 4806, 4808, 4810, and 4812. In some embodiments, the polypeptide sequence of the engineered glycosyltransferase comprises a sequence at least 95% identical to any of SEQ ID NOS: 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4902, 4804, 4806, 4808, 4810, and 4812. In some embodiments, the polypeptide sequence of the engineered glycosyltransferase comprises any of SEQ ID NOS: 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4902, 4804, 4806, 4808, 4810, and 4812.

The present invention also provides engineered glycosyltransferases, wherein the polypeptide sequences of the engineered glycosyltransferases comprise at least one mutation or mutation set at one or more positions selected from 51/56, 51/56/243/249/282/353/362/366, 51/56/243/249/308/362/364, 51/56/249/353, 51/56/249/362/364, 51/56/249/362/366, 51/243/249/308/353, 51/243/249/348/362/366, 51/249, 51/249/282/284/364, 51/249/282/353/366, 51/249/284/308/362/366, 51/249/353/362/364, 51/353/362, 56, 56/243/249/282/364/366, 56/243/364/366, 56/249, 56/249/284/353, 56/249/353, 56/284/366, 243/249/282/284/362/364/366, 243/249/308/353/366, 243/249/353/362/366, 243/282/353/362/364,243/282/362/364/366, 243/308/353,249/353/362/366, 282, 308/366, and 362/366, wherein the positions are numbered with reference to SEQ ID NO: 4684. In some embodiments, the polypeptide sequences of the engineered glycosyltransferases comprise at least one mutation or mutation set at one or more positions selected from 51A/56H, 51A/56H/243L/249E/282T/353Y/362M/366S, 51A/56H/243L/249E/308F/362M/364G, 51A/56H/249M/362M/364G, 51A/56H/249M/362M/366S, 51A/56H/249Y/353Y, 51A/243L/249E/308F/353Y, 51A/243L/249E/348S/362M/366V, 51A/249E/353Y/362M/364G, 51A/249M, 51A/249M/282T/284T/364G, 51A/249M/282T/353Y/366S, 51A/249Y/284T/308F/362M/366V, 51A/353Y/362M, 56H, 56H/243L/249E/282T/364G/366V, 56H/243L/364G/366V, 56H/249M/284T/353Y, 56H/249M/353Y, 56H/249Y, 56H/284T/366V, 243L/249E/282T/284T/362M/364G/366S, 243L/249M/308F/353Y/366A, 243L/249Y/353Y/362M/366S, 243L/282T/353Y/362M/364G, 243L/282T/362M/364G/366V, 243L/308F/353Y, 249Y/353Y/362M/366S, 282T, 308F/366A, and 362M/366A, wherein the positions are numbered with reference to SEQ ID NO: 4684. In some embodiments, the polypeptide sequences of the engineered glycosyltransferases comprise at least one mutation or mutation set at one or more positions selected from K51A/N56H, K51A/N56H/I243L/L249E/S282T/W353Y/L362M/C366S, K51A/N56H/I243L/L249E/R308F/L362M/S364G, K51A/N56H/L249M/L362M/S364G, K51A/N56H/L249M/L362M/C366S, K51A/N56H/L249Y/W353Y, K51A/I243L/L249E/R308F/W353Y, K51A/I243L/L249E/A348S/L362M/C366V, K51A/L249E/W353Y/L362M/S364G, K51A/L249M, K51A/L249M/S282T/S284T/S364G, K51A/L249M/S282T/W353Y/C366S, K51A/L249Y/S284T/R308F/L362M/C366V, K51A/W353Y/L362M, N56H, N56H/I243L/L249E/S282T/S364G/C366V, N56H/I243L/S364G/C366V, N56H/L249M/S284T/W353Y, N56H/L249M/W353Y, N56H/L249Y, N56H/S284T/C366V, I243L/L249E/S282T/S284T/L362M/S364G/C366S, I243L/L249M/R308F/W353Y/C366A, I243L/L249Y/W353Y/L362M/C366S, I243L/S282T/W353Y/L362M/S364G, I243L/S282T/L362M/S364G/C366V, I243L/R308F/W353Y, L249Y/W353Y/L362M/C366S, S282T, R308F/C366A, and L362M/C366A, wherein the positions are numbered with reference to SEQ ID NO: 4684. In some embodiments, the polypeptide sequence of the engineered glycosyltransferase comprises a sequence at least 90% identical to any of SEQ ID NOS: 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, and 4874. In some additional embodiments, the polypeptide sequence of the engineered glycosyltransferase comprises a sequence at least 95% identical to any of SEQ ID NOS: 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, and 4874. In some further embodiments, the polypeptide sequence of the engineered glycosyltransferase comprises any of SEQ ID NOS: 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, and 4874.

The present invention also provides engineered glycosyltransferases, wherein the polypeptide sequences of the engineered glycosyltransferases comprise at least one mutation or mutation set at one or more positions selected from 25, 25/56/353, 25/243/249/259/366, 25/243/249/362, 25/362/366, 51, 51/56/200/243/249/259/338, 51/56/362, 51/71/249/279/284/362/366, 56/243/249, 56/362/366, 70/198/259/313, 85, 88, 88/173, 110, 159, 163, 171, 174, 175, 177, 198, 198/313, 198/313/428, 200/243/249/259, 208, 208/320, 209, 209/234, 222, 226, 234, 234/408, 243/338/362/366, 253, 256, 259, 265, 272, 289, 322, 336, 353/362, 405, 411, 428, and 439, wherein the positions are numbered with reference to SEQ ID NO: 4838. In some embodiments, the polypeptide sequences of the engineered glycosyltransferases comprise at least one mutation or mutation set at one or more positions selected from 25L, 25L/56L/353Y, 25V/243M/249I/362M, 25V/243M/249Y/259G/366A, 25V/362M/366S, 51A, 51A/56L/200S/243M/249I/259G/338C, 51A/56L/362M, 51A/71R/249M/279G/284T/362M/366S, 56L/243M/249M, 56L/243M/249Y, 56L/362M/366A, 70S/198D/259E/313S, 85E, 88C/173S, 88I, 110S, 159N, 163K, 171D, 171E, 171P, 171V, 174E, 174S, 175N, 177K, 177P, 177S, 198D, 198D/313S, 198D/313S/428S, 198E, 198S, 198T, 200S/243M/249Y/259G, 208E, 208G, 208I, 208L, 208N, 208T, 208V, 208W/320I, 209A, 209E/234Q, 222P, 226R, 226T, 234A, 234E, 234H/408D, 234T, 243M/338C/362M/366S, 253A, 256A, 259N, 259S, 259T, 265A, 272D, 289H, 289T, 322V, 336E, 353Y/362M, 405Q, 411T, 428K, 439D, and 439Q, wherein the positions are numbered with reference to SEQ ID NO: 4838. In some additional embodiments, the polypeptide sequences of the engineered glycosyltransferases comprise at least one mutation or mutation set at one or more positions selected from I25L, I25L/H56L/W353Y, I25V/L243M/E249I/L362M, I25V/L243M/E249Y/H259G/V366A, I25V/L362M/V366S, K51A, K51A/H56L/K200S/L243M/E249I/H259G/V338C, K51A/H56L/L362M, K51A/Q71R/E249M/S279G/S284T/L362M/V366S, H56L/L243M/E249M, H56L/L243M/E249Y, H56L/L362M/V366A, P70S/I198D/H259E/F313S, A85E, R88C/R173S, R88I, A110S, Q159N, L163K, K171D, K171E, K171P, K171V, L174E, L174S, E175N, Q177K, Q177P, Q177S, I198D, I198D/F313S, I198D/F313S/V428S, I198E, I198S, I198T, K200S/L243M/E249Y/H259G, K208E, K208G, K208I, K208L, K208N, K208T, K208V, K208W/V320I, Q209A, Q209E/R234Q, K222P, E226R, E226T, R234A, R234E, R234H/N408D, R234T, L243M/V338C/L362M/V366S, S253A, L256A, H259N, H259S, H259T, Q265A, P272D, K289H, K289T, P322V, K336E, W353Y/L362M, E405Q, R411T, V428K, K439D, and K439Q, wherein the positions are numbered with reference to SEQ ID NO: 4838. In some embodiments, the polypeptide sequence of the engineered glycosyltransferase comprises a sequence at least 90% identical to any of SEQ ID NOS: 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, and 5016. In some embodiments, the polypeptide sequence of the engineered glycosyltransferase comprises a sequence at least 95% identical to any of SEQ ID NOS: 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, and 5016. In some embodiments, the polypeptide sequence of the engineered glycosyltransferase comprises any of SEQ ID NOS: 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, and 5016.

The present invention also provides engineered glycosyltransferases, wherein the polypeptide sequences of the engineered glycosyltransferases comprise at least one mutation or mutation set at one or more positions selected from 8, 9, 25, 25/198/209, 25/200/209/338, 25/200/243/249, 25/209/243, 25/209/243/249, 25/209/243/259, 25/209/249/259/366, 25/209/259, 25/209/279/366, 25/209/289/366, 25/249, 25/259/279, 25/259/279/289, 25/279/284, 25/279/284/289, 25/289, 34, 53, 54, 55, 61, 69, 70, 73, 79, 87, 91, 107, 108, 111, 141, 153, 158, 174, 190, 194, 198, 198/200/209/243/249/289, 198/249/338, 200/209/366,201, 205, 209, 209/249/259/279/338/366, 209/249/259/289, 209/249/279/284/289, 209/249/338, 209/279/289, 209/366, 234/297, 238, 247, 249/259, 252, 253, 254, 256, 259/366, 279, 279/338, 289, 297, 308, 321, 322, 327, 336, 338, 341, 342, 364, 366, 388, 392, 411, 412, 414, 426, 430, 432, 446, and 449, wherein the positions are numbered with reference to SEQ ID NO:4876. In some embodiments, the polypeptide sequence of the engineered glycosyltransferase comprises at least one mutation or mutation set at one or more positions selected from 8D, 8L, 9G, 25H/209E/243M/249Y, 25L, 25L/198D/209E, 25L/200S/209E/338C, 25L/200S/243M/249M, 25L/209E/243M, 25L/209E/243M/249Y, 25L/209E/243M/259G, 25L/209E/249I/259G/366A, 25L/209E/259G, 25L/209E/279G/366A, 25L/209E/289T/366A, 25L/249I, 25L/259G/279G, 25L/259G/279G/289T, 25L/279G/284T, 25L/279G/284T/289T, 25L/289T, 34I, 53C, 53L, 53R, 53V, 54P, 54V, 55T, 55W, 61S, 69N, 69Q, 69S, 69T, 70K, 73S, 79G, 79S, 79V, 87L, 87M, 87R, 91Q, 91R, 91T, 107A, 107C, 107T, 108C, 111C, 111G, 141M, 153S, 158Q, 174M, 190R, 194Q, 198D, 198D/200S/209E/243M/249Y/289T, 198D/249M/338C, 200S/209E/366A, 201P, 201T, 205P, 209E, 209E/249I/259G/289T, 209E/249M/338C, 209E/249Y/259G/279G/338C/366A, 209E/249Y/279G/284T/289T, 209E/279G/289T, 209E/366A, 234H/297A, 238K, 247A, 247L, 249M/259G, 252A, 252E, 252Q, 253G, 253P, 254G, 254M, 254P, 256D, 256T, 256W, 259G/366A, 279G, 279G/338C, 289T, 297A, 308C, 308L, 308T, 321D, 322M, 322R, 322T, 327L, 336M, 336Y, 338C, 341V, 342R, 364S, 366A, 388T, 388V, 392H, 392Q, 411E, 411S, 412H, 412T, 414L, 426T, 430R, 432T, 446F, and 449L, wherein the positions are numbered with reference to SEQ ID NO:4876. In some additional embodiments, the polypeptide sequence of the engineered glycosyltransferase comprises at least one mutation or mutation set at one or more positions selected from T8D, T8L, V9G, I25H/Q209E/L243M/E249Y, I25L, I25L/I198D/Q209E, I25L/K200S/Q209E/V338C, I25L/K200S/L243M/E249M, I25L/Q209E/L243M, I25L/Q209E/L243M/E249Y, I25L/Q209E/L243M/H259G, I25L/Q209E/E249I/H259G/V366A, I25L/Q209E/H259G, I25L/Q209E/S279G/V366A, I25L/Q209E/K289T/V366A, I25L/E249I, I25L/H259G/S279G, I25L/H259G/S279G/K289T, I25L/S279G/S284T, I25L/S279G/S284T/K289T, I25L/K289T, V34I, K53C, K53L, K53R, K53V, T54P, T54V, S55T, S55W, T61S, D69N, D69Q, D69S, D69T, P70K, E73S, P79G, P79S, P79V, W87L, W87M, W87R, I91Q, I91R, I91T, L107A, L107C, L107T, M108C, S111C, S111G, L141M, A153S, P158Q, L174M, K190R, S194Q, I198D, I198D/K200S/Q209E/L243M/E249Y/K289T, I198D/E249M/V338C, K200S/Q209E/V366A, E201P, E201T, K205P, Q209E, Q209E/E249I/H259G/K289T, Q209E/E249M/V338C, Q209E/E249Y/H259G/S279G/V338C/V366A, Q209E/E249Y/S279G/S284T/K289T, Q209E/S279G/K289T, Q209E/V366A, R234H/G297A, A238K, K247A, K247L, E249M/H259G, S252A, S252E, S252Q, S253G, S253P, S254G, S254M, S254P, L256D, L256T, L256W, H259G/V366A, S279G, S279G/V338C, K289T, G297A, R308C, R308L, R308T, E321D, P322M, P322R, P322T, F327L, K336M, K336Y, V338C, Q341V, E342R, G364S, V366A, S388T, S388V, K392H, K392Q, R411E, R411S, R412H, R412T, M414L, A426T, K430R, K432T, S446F, and S449L, wherein the positions are numbered with reference to SEQ ID NO:4876. In some embodiments, the polypeptide sequence of the engineered glycosyltransferase comprises a sequence at least 90% identical to any of SEQ ID NOS: 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, and 5260. In some embodiments, the polypeptide sequence of the engineered glycosyltransferase comprises a sequence at least 95% identical to any of SEQ ID NOS: 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, and 5260. In some embodiments, the polypeptide sequence of the engineered glycosyltransferase comprises any of SEQ ID NOS: 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, and 5260.

The present invention also provides engineered glycosyltransferases, wherein the polypeptide sequences of the engineered glycosyltransferases comprise at least one mutation or mutation set at one or more positions selected from 88, 88/110, 88/110/159/198/200, 88/110/159/198/234/259/265, 88/110/159/198/259, 88/110/198, 88/110/234, 88/159/198, 88/198, 88/198/200/259, 88/198/259, 88/259, 88/259/265, 110/259/265/411, 159/198/411, 159/259/411, 171/174/175/177/208/320/428/439, 171/175/177/208/320/428, 171/177, 171/177/226/428/439, 171/208/320, 171/208/320/428, 171/208/428, 174/175/177/208/320/428, 174/175/428, 174/320, 198, 198/200, 198/200/234, 198/234, 198/259, 208, 208/320/331/428, 208/320/428, 208/428, 234, 259, 320/428, and 428, wherein the positions are numbered with reference to SEQ ID NO: 5066. In some embodiments, the polypeptide sequences of the engineered glycosyltransferases comprise at least one mutation or mutation set at one or more positions selected from 88, 88I/110D, 88I/110D/159N/198D/234T/259N/265A, 88I/110D/159N/198D/259E, 88I/110D/159N/198E/200S, 88I/110D/198D, 88I/110D/198S, 88I/110D/234T, 88I/159N/198D, 88I/198D/200S/259E, 88I/198D/259E, 88I/198S, 88I/259E/265A, 88I/259N, 110D/259N/265A/411T, 159N/198E/411T, 159N/259E/411T, 171E/177P/226T/428K/439D, 171E/208E/320I, 171E/208E/320I/428K, 171E/208E/428K, 171P/174E/175N/177P/208W/320I/428K/439D, 171P/175N/177P/208L/320I/428K, 171P/177P, 174E/175N/177P/208E/320I/428K, 174E/175N/428K, 174E/320I, 198D, 198D/200S/234E, 198D/234Q, 198E/200S, 198E/259E, 208E, 208E/320I/428K, 208E/428K, 208L/320I/331C/428K, 234E, 259E, 320I/428K, and 428K, wherein the positions are numbered with reference to SEQ ID NO: 5066. In some embodiments, the polypeptide sequences of the engineered glycosyltransferases comprise at least one mutation or mutation set at one or more positions selected from R88I, R88I/A101D, R88I/A110D/Q159N/I198D/R234T/G259N/Q265A, R88I/A110D/Q159N/I198D/G259E, R88I/A110D/Q159N/I198E/K200S, R88I/A110D/I198D, R88I/A110D/I198S, R88I/A110D/R234T, R88I/Q159N/I198D, R88I/I198D/K200S/G259E, R88I/I198D/G259E, R88I/I198S, R88I/G259E/Q265A, R88I/G259N, A110D/G259N/Q265A/R411T, Q159N/I198E/R411T, Q159N/G259E/R411T, K171E/Q177P/E226T/V428K/K439D, K171E/K208E/V320I, K171E/K208E/V320I/V428K, K171E/K208E/V428K, K171P/L174E/E175N/Q177P/K208W/V320I/V428K/K439D, K171P/E175N/Q177P/K208L/V320I/V428K, K171P/Q177P, L174E/E175N/Q177P/K208E/V320I/V428K, L174E/E175N/V428K, L174E/V320I, I198D, I198D/K200S/R234E, I198D/R234Q, I198E/K200S, I98E/G259E, K208E, K208E/V320I/V428K, K208E/V428K, K208L/V320I/R331C/V428K, R234E, G259E, V320I/V428K, and V428K, wherein the positions are numbered with reference to SEQ ID NO: 5066. In some embodiments, the polypeptide sequence of the engineered glycosyltransferase comprises a sequence at least 90% identical to any of SEQ ID NOS: 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, and 5342. In some embodiments, the polypeptide sequence of the engineered glycosyltransferase comprises a sequence at least 95% identical to any of SEQ ID NOS: 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, and 5342. In some embodiments, the polypeptide sequence of the engineered glycosyltransferase comprises any of SEQ ID NOS: 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, and 5342.

The present invention also provides engineered glycosyltransferases, wherein the polypeptide sequences of the engineered glycosyltransferases comprise at least one mutation or mutation set at one or more positions selected from 2, 7, 25/61/208/252/253, 25/61/428, 25/107/208/320/428, 25/208/247/252/253/364/428, 25/247/249/252/364/428, 38, 53/54/55/153/201, 53/54/308/392, 53/171/308/392, 54, 61/107/208/252/253/254/364/428, 61/208/252/254/428, 64, 68, 73/87/201, 91/201/439/444, 99, 106, 107, 107/208/320/364/428, 107/247/249/252/254/364, 107/247/252, 107/247/428, 109, 159, 169, 171, 172, 177, 179, 190, 190/208/247/252/428, 222, 233, 233/269, 247/249/252/254/320/428, 249/252/253/254, 249/252/254/428, 251, 252/253/254, 253/320, 259, 264, 289, 296, 300, 308, 308/327/439, 317, 318, 320, 320/364/428, 320/428, 347, 404, 408, 417, 424, 427, 428, 428/434, 431, 435, and 438, wherein the positions are numbered with reference to SEQ ID NO: 5290. In some embodiments, the polypeptide sequence of the engineered glycosyltransferase comprises at least one mutation or mutation set at one or more positions selected from 2L, 2N, 7P, 25L/61S/208N/252E/253G, 25L/61S/428K, 25L/107T/208E/320I/428K, 25L/208E/247L/252E/253G/364S/428K, 25L/247L/249I/252E/364S/428K, 38Q, 53R/54V/55T/153S/201P, 53V/54V/308L/392H, 53V/171P/308L/392H, 54A, 61S/107T/208N/252E/253G/254M/364S/428K, 61S/208W/252E/254M/428K, 64S, 68K, 73S/87M/201P, 91T/201P/439D/444H, 99P, 106T, 107A, 107A/208N/320I/364S/428K, 107A/247A/249I/252E/254M/364S, 107A/247A/252E, 107A/247A/428K, 109, 159L, 169C, 169E, 169L, 169Q, 169V, 171S, 171T, 171V, 172H, 172N, 177P, 179A, 179S, 190R, 190R/208N/247L/252E/428K, 222A, 233C, 233G, 233K, 233L, 233M, 233Q, 233Q/269R, 233V, 247A/249I/252E/254M/320I/428K, 249I/252E/253G/254M, 249I/252E/254M/428K, 251L, 252E/253G/254M, 253G/320I, 259T, 264A, 289S, 296A, 296H, 296Q, 300G, 308L, 308L/327L/439D, 317R, 318T, 320I, 320I/364S/428K, 320I/428K, 347H, 347K, 347P, 347R, 404T, 408R, 417P, 424A, 424W, 427L, 427R, 428E/434N, 428F, 428I, 428K, 428Q, 428R, 428S, 431E, 431R, 435C, 435K, 435M, 435Q, 435R, 435T, and 438Q, wherein the positions are numbered with reference to SEQ ID NO: 5290. In some embodiments, the polypeptide sequence of the engineered glycosyltransferase comprises at least one mutation or mutation set at one or more positions selected from E2L, E2N, T7P, I25L/T61S/K208N/S252E/S253G, I25L/T61S/V428K, I25L/L107T/K208E/V320I/V428K, I25L/K208E/K247L/S252E/S253G/G364S/V428K, I25L/K247L/Y249I/S252E/

G364S/V428K, R38Q, K53R/T54V/S55T/A153S/E201P, K53V/T54V/R308L/K392H, K53V/K171P/R308L/K392H, T54A, T61S/L107T/K208N/S252E/S253G/S254M/G364S/ V428K, T61S/K208W/S252E/S254M/V428K, F64S, N68K, E73S/W87M/E201P, I91T/E201P/K439D/Y444H, E99P, S106T, L107A, L107A/K208N/V320I/G364S/ V428K, L107A/K247A/Y249I/S252E/S254M/G364S, L107A/K247A/S252E, L107A/K247A/V428K, R109S, N159L, G169C, G169E, G169L, G169Q, G169V, K171S, K171T, K171V, T172H, T172N, Q177P, V179A, V179S, K190R, K190R/K208N/K247L/S252E/V428K, K222A, W233C, W233G, W233K, W233L, W233M, W233Q, W233Q/Q269R, W233V, K247A/Y249I/S252E/S254M/ V320I/V428K, Y249I/S252E/S253G/S254M, Y249I/ S252E/S254M/V428K, A251L, S252E/S253G/S254M, S253G/V320I, E259T, F264A, K289S, R296A, R296H, R296Q, D300G, R308L, R308L/F327L/K439D, S317R, E318T, V320I, V320I/G364S/V428K, V320I/V428K, D347H, D347K, D347P, D347R, G404T, N408R, R417P, Q424A, Q424W, A427L, A427R, V428E/D434N, V428F, V428I, V428K, V428Q, V428R, V428S, D431E, D431R, V435C, V435K, V435M, V435Q, V435R, V435T, and A438Q, wherein the positions are numbered with reference to SEQ ID NO: 5290. In some embodiments, the polypeptide sequence of the engineered glycosyltransferase comprises a sequence at least 90% identical to any of SEQ ID NOS: 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, and 5542. In some embodiments, the polypeptide sequence of the engineered glycosyltransferase comprises a sequence at least 95% identical to any of SEQ ID NOS: 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, and 5542. In some embodiments, the polypeptide sequence of the engineered glycosyltransferase comprises any of SEQ ID NOS: 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, and 5542.

The present invention also provides engineered glycosyltransferases, wherein the polypeptide sequences of the engineered glycosyltransferases comprise at least one mutation or mutation set at one or more positions selected from 2, 49, 73, 87, 87/88, 87/88/94/159/177/208, 87/88/159/198, 87/88/ 177/198/249, 87/88/208, 87/159/177, 87/159/320, 87/177/ 249, 87/198, 87/198/199, 87/198/208/320, 87/208, 87/208/ 320, 87/320, 88, 88/177, 88/177/208, 88/177/320, 88/198, 88/199, 88/199/208, 88/208, 88/208/249/320, 88/320, 113, 134, 135, 158, 159/177/198, 159/177/208, 159/198/208/320, 171, 173, 177/198, 177/208, 195, 214, 222, 253, 256, 257, 268, 272, 289, 300, 302, 330, 348, 374, 392, 399, 408, 411, 412, 437, 439, 445, and 453, wherein the positions are numbered with reference to SEQ ID NO: 5372. In some embodiments, the polypeptide sequence of the engineered glycosyltransferase comprises at least one mutation or mutation set at one or more positions selected from 2G, 2H, 2P, 49A, 73P, 73T, 87M, 87M/88R, 87M/88R/94K/159Q/177P/ 208E, 87M/88R/159Q/198E, 87M/88R/177P/198E/249I, 87M/88R/208E, 87M/159Q/177P, 87M/159Q/320I, 87M/ 177P/249I, 87M/198E, 87M/198E/199K, 87M/198E/208E/ 320I, 87M/208E, 87M/208E/320I, 87M/320I, 88R, 88R/ 177P, 88R/177P/208E, 88R/177P/320I, 88R/198I, 88R/ 199K, 88R/199K/208E, 88R/208E, 88R/208E/249I/320I, 88R/320I, 113S, 134G, 134S, 135A, 158D, 158E, 159Q/ 177P/198E, 159Q/177P/208E, 159Q/198I/208E/320I, 171T, 173N, 173P, 177P/198E, 177P/208E, 195H, 214L, 222R, 253G, 256P, 257A, 257Q, 268A, 268G, 268H, 272K, 289T, 300G, 302R, 330D, 348C, 374K, 374R, 392D, 399D, 408D, 411Q, 412H, 437I, 437T, 437V, 439A, 445T, and 453R, wherein the positions are numbered with reference to SEQ ID NO: 5372. In some embodiments, the polypeptide sequence of the engineered glycosyltransferase comprises at least one mutation or mutation set at one or more positions selected from E2G, E2H, E2P, F49A, E73P, E73T, W87M, W87M/I88R, W87M/I88R/E94K/N159Q/Q177P/K208E, W87M/I88R/N159Q/D198E, W87M/I88R/Q177P/D198E/ Y249I, W87M/I88R/K208E, W87M/N159Q/Q177P, W87M/N159Q/V320I, W87M/Q177P/Y249I, W87M/ D198E, W87M/D198E/A199K, W87M/D198E/K208E/ V320I, W87M/K208E, W87M/K208E/V320I, W87M/ V320I, I88R, I88R/Q177P, I88R/Q177P/K208E, I88R/ Q177P/V320I, I88R/D198I, I88R/A199K, I88R/A199K/ K208E, I88R/K208E, I88R/K208E/Y249I/V320I, I88R/ V320I, E113S, D134G, D134S, S135A, P158D, P158E, N159Q/Q177P/D198E, N159Q/Q177P/K208E, N159Q/ D198I/K208E/V320I, K171T, R173N, R173P, Q177P/ D198E, Q177P/K208E, N195H, S214L, K222R, S253G, L256P, L257A, L257Q, D268A, D268G, D268H, P272K, K289T, D300G, K302R, E330D, A348C, S374K, S374R, K392D, N399D, N408D, R411Q, R412H, L437I, L437T, L437V, K439A, E445T, and Y453R, wherein the positions are numbered with reference to SEQ ID NO: 5372. In some embodiments, the polypeptide sequence of the engineered glycosyltransferase comprises a sequence at least 90% identical to any of SEQ ID NOS: 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, 5642, 5644, 5646, 5648, 5650, 5652, 5654, 5656, 5658, 5660, 5662, 5664, 5666, 5668, 5670, 5672, 5674, 5676, 5678, 5680, 5682, 5684, 5686, 5688, and 5690. In some embodiments, the polypeptide sequence of the engineered glycosyltransferase comprises a sequence at least 95% identical to any of SEQ ID NOS: 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, 5642, 5644, 5646, 5648, 5650, 5652, 5654, 5656, 5658, 5660, 5662, 5664, 5666, 5668, 5670, 5672, 5674, 5676, 5678, 5680, 5682, 5684, 5686, 5688, and 5690. In some embodiments, the polypeptide sequence of the engineered glycosyltransferase comprises any of SEQ ID NOS: 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, 5642, 5644, 5646, 5648, 5650, 5652, 5654, 5656, 5658, 5660, 5662, 5664, 5666, 5668, 5670, 5672, 5674, 5676, 5678, 5680, 5682, 5684, 5686, 5688, and 5690.

The present invention also provides engineered glycosyltransferases, wherein the polypeptide sequences of the engineered glycosyltransferases comprise at least one mutation or mutation set at one or more positions selected from 2/7/107/233/252/253/320, 2/7/107/233/252/253/320/408/428, 2/7/233/252/253/320/427/428, 2/233/252/317/320, 7/107/190/233/252/253/317/408/427, 7/107/233/252/253, 7/107/233/252/317/320, 7/107/233/252/317/408, 7/190/233/252/253/320/427, 7/190/233/252/317/320/427/428, 7/190/233/252/408/427, 7/233/252/253/317/408/427, 7/233/252/253/408, 7/233/252/317/320/427, 7/233/252/317/428, 64/169/201/347/392, 64/172/264/268/347/392/417, 91/94/171/172/201/264/347, 91/201/264/347/392, 94/201/264/347/435, 107/190/233/252, 107/190/233/252/317/320, 107/233/252/253, 107/252/317, 169/171/172/264/392/435, 169/171/201/264/392/435, 169/172/201/264/347, 169/172/201/264/347/392/435, 169/172/201/347/392, 169/172/201/417/435, 171/172/201/264/392/417/435, 171/201/392/417, 190/233/252, 190/233/252/253/317/320/408/428, 190/233/252/317/408, 190/233/252/320/408, 201/264/347/392/417/435, 201/264/347/392/435, 201/264/347/417/435, 233/252/253/317/320/427/428, 233/252/253/408/427, 233/252/317/408, 233/252/317/427, 233/252/320, 233/252/320/408/428, 348/374/435, and 374, wherein the positions are numbered with reference to SEQ ID NO: 5562. In some embodiments, the polypeptide sequence of the engineered glycosyltransferase comprises at least one mutation or mutation set at one or more positions selected from 2L/7P/233K/252E/253G/320I/427R/428R, 2N/7P/107A/233K/252E/253G/320I, 2N/7P/107A/233K/252E/253G/320I/408R/428R, 2N/233K/252E/317R/320I, 7P/107A/190R/233K/252E/253G/317R/408R/427R, 7P/107A/233K/252E/253G, 7P/107A/233K/252E/317R/320I, 7P/107A/233K/252E/317R/408R, 7P/190R/233K/252E/253G/320I/427L, 7P/190R/233K/252E/317R/320I/427R/428R, 7P/190R/233K/252E/408R/427R, 7P/233K/252E/253G/317R/408R/427L, 7P/233K/252E/253G/408R, 7P/233K/252E/317R/320I/427L, 7P/233K/252E/317R/428R, 64S/169E/201P/347P/392H, 64S/172H/264A/268V/347P/392H/417P, 91T/94E/171T/172H/201P/264A/347G, 91T/201P/264A/347G/392H, 94E/201P/264A/347G/435Q, 107A/190R/233K/252E, 107A/190R/233K/252E/317R/320I, 107A/233K/252E/253G, 107A/252E/317R, 169E/171T/172H/264A/392H/435Q, 169E/171T/201P/264A/392H/435Q, 169E/172H/201P/264A/347G, 169E/172H/201P/264A/347K/392H/435R, 169E/172H/201P/347G/392H, 169E/172H/201P/417P/435R, 171T/172H/201P/264A/392H/417P/435R, 171T/201P/392H/417P, 190R/233K/252E, 190R/233K/252E/253G/317R/320I/408R/428R, 190R/233K/252E/317R/408R, 190R/233K/252E/320I/408R, 201P/264A/347K/392H/417P/435R, 201P/264A/347K/417P/435R, 201P/264A/347P/392H/435Q, 233K/252E/253G/317R/320I/427R/428R, 233K/252E/253G/408R/427L, 233K/252E/317R/427R, 233K/252E/320I, 233K/252E/320I/408R/428R, 348S/374R/435R, and 374R, wherein the positions are numbered with reference to SEQ ID NO: 5562. In some embodiments, the polypeptide sequence of the engineered glycosyltransferase comprises at least one mutation or mutation set at one or more positions selected from E2L/T7P/W233K/S252E/S253G/V320I/A427R/K428R, E2N/T7P/L107A/W233K/S252E/S253G/V320I, E2N/T7P/L107A/W233K/S252E/S253G/V320I/N408R/K428R, E2N/W233K/S252E/S317R/V320I, T7P/L107A/K190R/W233K/S252E/S253G/S317R/N408R/A427R, T7P/L107A/W233K/S252E/S253G, T7P/L107A/W233K/S252E/S317R/V320I, T7P/L107A/W233K/S252E/S317R/N408R, T7P/K190R/W233K/S252E/S253G/V320I/A427L, T7P/K190R/W233K/S252E/S317R/V320I/A427R/K428R, T7P/K190R/W233K/S252E/N408R/A427R, T7P/W233K/S252E/S253G/S317R/N408R/A427L, T7P/W233K/S252E/S253G/N408R, T7P/W233K/S252E/S317R/V320I/A427L, T7P/W233K/S252E/S317R/K428R, F64S/G169E/E201P/D347P/K392H, F64S/T172H/F264A/D268V/D347P/K392H/R417P, I91T/K94E/K171T/T172H/E201P/F264A/D347G, I91T/E201P/F264A/D347G/K392H, K94E/E201P/F264A/D347G/V435Q, L107A/K190R/W233K/S252E, L107A/K190R/W233K/S252E/S317R/V320I, L107A/W233K/S252E/S253G, L107A/S252E/S317R, G169E/K171T/T172H/F264A/K392H/V435Q, G169E/K171T/E201P/F264A/K392H/V435Q, G169E/T172H/E201P/F264A/D347G, G169E/T172H/E201P/F264A/D347K/K392H/V435R, G169E/T172H/E201P/D347G/K392H, G169E/T172H/E201P/R417P/V435R, K171T/T172H/E201P/F264A/K392H/R417P/V435R, K171T/E201P/K392H/R417P, K190R/W233K/S252E, K190R/W233K/S252E/S253G/S317R/V320I/N408R/K428R, K190R/W233K/S252E/S317R/N408R, K190R/W233K/S252E/V320I/N408R, E201P/F264A/D347K/K392H/R417P/V435R, E201P/F264A/D347K/R417P/V435R, E201P/F264A/D347P/K392H/V435Q, W233K/S252E/S253G/S317R/V320I/A427R/K428R, W233K/S252E/S253G/N408R/A427L, W233K/S252E/S317R/N408R, W233K/S252E/S317R/A427R, W233K/S252E/V320I, W233K/S252E/V320I/N408R/K428R, A348S/S374R/V435R, and S374R, wherein the positions are numbered with reference to SEQ ID NO: 5562. In some embodiments, the polypeptide sequence of the engineered glycosyltransferase comprises at least one mutation or mutation set at one or more positions selected from 14, 55, 56, 255, 282, 308, 336, 342, 364, 391, 407, and 422, wherein the positions are numbered with reference to SEQ ID NO: 5562. In some embodiments, the polypeptide sequence of the engineered glycosyltransferase comprises at least one mutation or mutation set at one or more positions selected from 14I, 55V, 56A, 255L, 282S, 308L, 308Q, 336Q, 342W, 364A, 364S, 391C, 407C, 407V, and 422Q, wherein the positions are numbered with reference to SEQ ID NO: 5562. In some embodiments, the polypeptide sequence of the engineered glycosyltransferase comprises at least one mutation or mutation set at one or more positions selected from V14I, S55V, L56A, S255L, T282S, R308L, R308Q, K336Q, E342W, G364A, G364S, L391C, E407C, E407V, and M422Q, wherein the positions are numbered with reference to SEQ ID NO: 5562. In some embodiments, the polypeptide sequence of the engineered glycosyltransferase comprises a sequence at least 90% identical to any of SEQ ID NOS: 5692, 5694, 5696, 5698, 5700, 5702, 5704, 5706, 5708, 5710, 5712, 5714, 5716, 5718, 5720, 5722, 5724, 5726, 5728, 5730, 5732, 5734, 5736, 5738, 5740, 5742, 5744, 5746, 5748, 5750, 5752, 5754, 5756, 5758, 5760, 5762, 5764, 5766, 5768, 5770, 5772, 5774, 5776, 5778, 5780, 5782, 5784, 5786, 5788, 5790, 5792, 5794, 5796, 5798, 5800, 5802, 5804, 5806, 5808, 5810, 5812, and 5814. In some embodiments, the polypeptide sequence of the engineered glycosyltransferase comprises a sequence at least 95% identical to any of SEQ ID NOS: 5692, 5694, 5696, 5698, 5700, 5702, 5704, 5706, 5708, 5710, 5712, 5714, 5716, 5718, 5720, 5722, 5724, 5726, 5728, 5730, 5732, 5734, 5736, 5738, 5740, 5742, 5744, 5746, 5748, 5750, 5752, 5754, 5756, 5758, 5760, 5762, 5764, 5766, 5768, 5770, 5772, 5774, 5776, 5778, 5780, 5782, 5784, 5786, 5788, 5790, 5792, 5794, 5796, 5798, 5800, 5802, 5804, 5806, 5808, 5810, 5812, and 5814. In some embodiments, the polypeptide sequence of the engineered glycosyltransferase comprises any of SEQ ID NOS: 5692, 5694, 5696, 5698, 5700, 5702, 5704, 5706, 5708, 5710, 5712, 5714, 5716, 5718, 5720, 5722, 5724, 5726, 5728, 5730, 5732, 5734, 5736, 5738, 5740, 5742, 5744, 5746, 5748, 5750, 5752, 5754, 5756, 5758, 5760, 5762, 5764, 5766, 5768, 5770, 5772, 5774, 5776, 5778, 5780, 5782, 5784, 5786, 5788, 5790, 5792, 5794, 5796, 5798, 5800, 5802, 5804, 5806, 5808, 5810, 5812, and 5814.

The present invention also provides engineered glycosyltransferases, wherein the polypeptide sequences of the engineered glycosyltransferases comprise at least one mutation or mutation set at one or more positions selected from 2/4/113/158/163/302/364/399/449, 2/4/113/158/163/330/449, 2/4/113/163/449, 2/4/158/163/364/449, 2/4/158/222/257/302/330, 2/4/158/330, 2/4/163/222/302/330/364/449, 2/4/163/257, 2/4/163/257/330/399/449, 2/4/163/330/449, 2/4/163/364, 2/4/163/364/453, 2/4/302, 2/113, 2/113/163, 2/113/163/449, 2/113/330/399, 2/113/449, 2/158/163, 2/158/163/364/399, 2/163/364/453, 2/364/449, 4/113/158/163/330/364/399, 4/113/158/302/330/364, 4/113/163/364/399, 4/158/163/364/399, 4/364/449, 87, 87/95/198, 87/198, 87/266, 87/322, 107/134/135/195/412/417, 107/195/268/322/439, 107/195/272, 107/195/417/439, 107/374/417/439, 113/158/163/364/399, 134, 134/135/195/268/317, 158/163/257/330/364/449, 158/163/302/330/364/399, 158/163/364, 163/257/302/364, 163/302/330/364/449, 163/364, 173, 173/190/233/252/427/437, 173/190/252/257/347/427/437, 173/190/257/374/437, 173/190/257/427/437, 173/233/252/257/427, 173/233/437, 173/252, 173/252/268/437, 173/252/347/411, 173/257/374/437, 173/374/437, 173/427/437, 190/233/252/257/347/411/437, 190/252, 190/252/257/285/427, 190/252/257/411/437, 190/252/257/427, 190/374/427/437, 195/272/320/439, 195/317/320, 198, 198/244, 198/292, 233/252, 233/252/257, 233/252/257/347, 233/252/257/347/411/437, 233/252/257/427/437, 233/252/285, 233/252/285/437, 233/252/411/437, 233/252/437, 233/374, 233/374/437, 252/257, 252/257/347/437, 257/347/411/437, 268/417, 285/347/437, 302/364, 330/364, 347/411/437, 347/427/437, 364/399, 374, 374/411/437, 408/417, 411/437, and 437, wherein the positions are numbered with reference to SEQ ID NO:5708. In some embodiments, the polypeptide sequence of the engineered glycosyltransferase comprises at least one mutation or mutation set at one or more positions selected from 2P/4T/113S/158D/163A/330D/449R, 2P/4T/113S/158D/163R/302R/364S/399D/449R, 2P/4T/113S/163R/449R, 2P/4T/158D/163A/364S/449R, 2P/4T/158D/222R/257Q/302R/330D, 2P/4T/158D/330D, 2P/4T/163A/257Q, 2P/4T/163A/330D/449R, 2P/4T/163A/364S, 2P/4T/163A/364S/453R, 2P/4T/163R/222R/302R/330D/364S/449R, 2P/4T/163R/257Q/330D/399D/449R, 2P/4T/302R, 2P/113S, 2P/113S/163A, 2P/113S/163R/449R, 2P/113S/330D/399D, 2P/113S/449R, 2P/158D/163A/364S/399D, 2P/158D/163R, 2P/163R/364S/453R, 2P/364S/449R, 4T/113S/158D/163A/330D/364S/399D, 4T/113S/158D/302R/330D/364S, 4T/113S/163A/364S/399D, 4T/158D/163A/364S/399D, 4T/364S/449R, 87W, 87W/95L/198E, 87W/198E, 87W/198I, 87W/266L, 87W/322S, 107A/134S/135A/195H/412H/417P, 107A/195H/268A/322L/439P, 107A/195H/272K, 107A/195H/417P/439P, 107A/374T/417P/439P, 113S/158D/163A/364S/399D, 113S/158D/163R/364S/399D, 134S, 134S/135A/195H/268A/317R, 158D/163A/257Q/330D/364S/449R, 158D/163A/364S, 158D/163R/302R/330D/364S/399D, 163A/257Q/302R/364S, 163A/364S, 163R/302R/330D/364S/449R, 173N, 173N/190R/233K/252E/427R/437V, 173N/190R/252E/257A/347G/427R/437I, 173N/190R/257A/374K/437V, 173N/190R/257A/427R/437I, 173N/233K/252E/257A/427R, 173N/233K/437I, 173N/252E, 173N/252E/268H/437V, 173N/252E/347G/411Q, 173N/257A/374K/437V, 173N/374K/437I, 173N/427R/437I, 190R/233K/252E/257A/347G/411Q/437I, 190R/252E, 190R/252E/257A/285Q/427R, 190R/252E/257A/411Q/437I, 190R/252E/257A/427R, 190R/374K/427R/437V, 195H/272K/320I/439P, 195H/317R/320I, 198E, 198E/292P, 198I, 198I/244L, 233K/252E, 233K/252E/257A, 233K/252E/257A/347G, 233K/252E/257A/347G/411Q/437I, 233K/252E/257A/427R/437V, 233K/252E/285Q, 233K/252E/285Q/437V, 233K/252E/411Q/437V, 233K/252E/437V, 233K/374K, 233K/374K/437I, 252E/257A, 252E/257A/347G/437V, 257A/347G/411Q/437V, 268A/417P, 285Q/347G/437V, 302R/364S, 330D/364S, 347G/411Q/437I, 347G/427R/437V, 364S/399D, 374K, 374K/411Q/437I, 374K/411Q/437V, 408D/417P, 411Q/437V, and 437, wherein the positions are numbered with reference to SEQ ID NO:5708. In some embodiments, the polypeptide sequence of the engineered glycosyltransferase comprises at least one mutation or mutation set at one or more positions selected from E2P/K4T/E113S/P158D/L163A/E330D/S449R, E2P/K4T/E113S/P158D/L163R/K302R/G364S/N399D/S449R, E2P/K4T/E113S/L163R/S449R, E2P/K4T/P158D/L163A/G364S/S449R, E2P/K4T/P158D/K222R/L257Q/K302R/E330D, E2P/K4T/P158D/E330D, E2P/K4T/L163A/L257Q, E2P/K4T/L163A/E330D/S449R, E2P/K4T/L163A/G364S, E2P/K4T/L163A/G364S/Y453R, E2P/K4T/L163R/K222R/K302R/E330D/G364S/S449R, E2P/K4T/L163R/L257Q/E330D/N399D/S449R, E2P/K4T/K302R, E2P/E113S, E2P/E113S/L163A, E2P/E113S/L163R/S449R, E2P/E113S/E330D/N399D, E2P/E113S/S449R, E2P/P158D/L163A/G364S/N399D, E2P/P158D/L163R, E2P/L163R/G364S/Y453R, E2P/G364S/S449R, K4T/E113S/P158D/L163A/E330D/G364S/N399D, K4T/E113S/P158D/K302R/E330D/G364S, K4T/E113S/L163A/G364S/N399D, K4T/P158D/L163A/G364S/N399D, K4T/G364S/S449R, M87W, M87W/H95L/D198E, M87W/D198E, M87W/D198I, M87W/W266L, M87W/P322S, L107A/D134S/S135A/N195H/R412H/R417P, L107A/N195H/D268A/P322L/K439P, L107A/N195H/P272K, L107A/N195H/R417P/K439P, L107A/S374T/R417P/K439P, E113S/P158D/L163A/G364S/N399D, E113S/P158D/L163R/G364S/N399D, D134S, D134S/S135A/N195H/D268A/S317R, P158D/L163A/L257Q/E330D/G364S/S449R, P158D/L163A/G364S, P158D/L163R/K302R/E330D/G364S/N399D, L163A/L257Q/K302R/G364S, L163A/G364S, L163R/K302R/E330D/G364S/S449R, R173N, R173N/K190R/W233K/S252E/A427R/L437V, R173N/K190R/S252E/L257A/K347G/A427R/L437I, R173N/K190R/L257A/S374K/L437V, R173N/K190R/L257A/A427R/L437I, R173N/W233K/S252E/L257A/A427R, R173N/

W233K/L437I, R173N/S252E, R173N/S252E/D268H/ L437V, R173N/S252E/K347G/R411Q, R173N/L257A/ S374K/L437V, R173N/S374K/L437I, R173N/A427R/ L437I, K190R/W233K/S252E/L257A/K347G/R411Q/ L437I, K190R/S252E, K190R/S252E/L257A/E285Q/ A427R, K190R/S252E/L257A/R411Q/L437I, K190R/ S252E/L257A/A427R, K190R/S374K/A427R/L437V, N195H/P272K/V320I/K439P, N195H/S317R/V320I, D198E, D198E/L292P, D198I, D198I/P244L, W233K/ S252E, W233K/S252E/L257A, W233K/S252E/L257A/ K347G, W233K/S252E/L257A/K347G/R411Q/L437I, W233K/S252E/L257A/A427R/L437V, W233K/S252E/ E285Q, W233K/S252E/E285Q/L437V, W233K/S252E/ R411Q/L437V, W233K/S252E/L437V, W233K/S374K, W233K/S374K/L437I, S252E/L257A, S252E/L257A/ K347G/L437V, L257A/K347G/R411Q/L437V, D268A/ R417P, E285Q/K347G/L437V, K302R/G364S, E330D/ G364S, K347G/R411Q/L437I, K347G/A427R/L437V, G364S/N399D, S374K, S374K/R411Q/L437I, S374K/ R411Q/L437V, N408D/R417P, R411Q/L437V, and L437I, wherein the positions are numbered with reference to SEQ ID NO:5708. In some embodiments, the polypeptide sequence of the engineered glycosyltransferase comprises a sequence at least 90% identical to any of SEQ ID NOS: 5816, 5818, 5820, 5822, 5824, 5826, 5828, 5830, 5832, 5834, 5836, 5838, 5840, 5842, 5844, 5846, 5848, 5850, 5852, 5854, 5856, 5858, 5860, 5862, 5864, 5866, 5868, 5870, 5872, 5874, 5876, 5878, 5880, 5882, 5884, 5886, 5888, 5890, 5892, 5894, 5896, 5898, 5900, 5902, 5904, 5906, 5908, 5910, 5912, 5914, 5916, 5918, 5920, 5922, 5924, 5926, 5928, 5930, 5932, 5934, 5936, 5938, 5940, 5942, 5944, 5946, 5948, 5950, 5952, 5954, 5956, 5958, 5960, 5962, 5964, 5966, 5968, 5970, 5972, 5974, 5976, 5978, 5980, 5982, 5984, 5986, 5988, 5990, 5992, 5994, 5996, 5998, 6000, 6002, 6004, 6006, 6008, 6010, 6012, and 6014. In some embodiments, the polypeptide sequence of the engineered glycosyltransferase comprises a sequence at least 95% identical to any of SEQ ID NOS: 5816, 5818, 5820, 5822, 5824, 5826, 5828, 5830, 5832, 5834, 5836, 5838, 5840, 5842, 5844, 5846, 5848, 5850, 5852, 5854, 5856, 5858, 5860, 5862, 5864, 5866, 5868, 5870, 5872, 5874, 5876, 5878, 5880, 5882, 5884, 5886, 5888, 5890, 5892, 5894, 5896, 5898, 5900, 5902, 5904, 5906, 5908, 5910, 5912, 5914, 5916, 5918, 5920, 5922, 5924, 5926, 5928, 5930, 5932, 5934, 5936, 5938, 5940, 5942, 5944, 5946, 5948, 5950, 5952, 5954, 5956, 5958, 5960, 5962, 5964, 5966, 5968, 5970, 5972, 5974, 5976, 5978, 5980, 5982, 5984, 5986, 5988, 5990, 5992, 5994, 5996, 5998, 6000, 6002, 6004, 6006, 6008, 6010, 6012, and 6014. In some embodiments, the polypeptide sequence of the engineered glycosyltransferase comprises any of SEQ ID NOS: 5816, 5818, 5820, 5822, 5824, 5826, 5828, 5830, 5832, 5834, 5836, 5838, 5840, 5842, 5844, 5846, 5848, 5850, 5852, 5854, 5856, 5858, 5860, 5862, 5864, 5866, 5868, 5870, 5872, 5874, 5876, 5878, 5880, 5882, 5884, 5886, 5888, 5890, 5892, 5894, 5896, 5898, 5900, 5902, 5904, 5906, 5908, 5910, 5912, 5914, 5916, 5918, 5920, 5922, 5924, 5926, 5928, 5930, 5932, 5934, 5936, 5938, 5940, 5942, 5944, 5946, 5948, 5950, 5952, 5954, 5956, 5958, 5960, 5962, 5964, 5966, 5968, 5970, 5972, 5974, 5976, 5978, 5980, 5982, 5984, 5986, 5988, 5990, 5992, 5994, 5996, 5998, 6000, 6002, 6004, 6006, 6008, 6010, 6012, and 6014.

The present invention also provides engineered glycosyltransferases, wherein the polypeptide sequences of the engineered glycosyltransferases comprise at least one mutation or mutation set at one or more positions selected from 2/4/14/158/282/364/449, 2/4/14/158/282/407, 2/4/14/163/ 198, 2/4/14/163/282/399, 2/4/14/198/308/407, 2/4/14/282/ 308/364, 2/4/14/282/308/407, 2/4/14/282/364, 2/4/158/163/ 364/399/407, 2/4/158/198/282/364/407, 2/4/163/198/282/ 308/342, 2/4/163/282/342/364, 2/4/163/364/399/449, 2/4/ 198/282/449, 2/4/198/364/391/449, 2/4/282/342/364/407, 2/14/158/198/407/449, 2/14/163/308/364, 2/14/163/364/ 407, 2/14/282, 2/14/282/308, 2/14/282/308/364, 2/14/282/ 399, 2/14/308, 2/14/308/364, 2/158/163/407/449, 2/163/ 282, 2/163/282/308/364, 2/198/282/308/342, 2/198/282/ 399, 2/282, 2/282/308/342/407, 2/282/308/391/407, 2/282/ 399, 2/282/399/407, 2/308, 2/308/364/399, 4/14/158/163/ 198/282/407, 4/14/158/282/364/391/407, 4/14/163/282, 4/14/163/282/308/342/407/449, 4/14/198/308/364, 4/14/ 282, 4/14/282/308/364/407/449, 4/14/282/342/399/407, 4/14/364/391, 4/158/282/364/399, 4/163/282/308/407, 4/198/399/407, 4/282/342/364/407, 4/282/364/407, 4/364, 12, 14/158/163/198/364, 14/158/163/282/364, 14/158/198/ 282/342/364/449, 14/158/364, 14/163/198/282/342/364/ 449, 14/163/282/308, 14/282, 14/282/308, 14/282/342/364/ 391, 14/282/364, 14/282/364/391/407/449, 14/282/399/407/ 449, 14/407, 37, 44, 70, 71/331, 74, 75, 90, 106, 108, 112, 114, 115, 131, 138, 139, 156, 158/282/407, 158/282/407/ 449, 158/364/399/407/449, 158/364/449, 162, 163/198/282/ 342, 163/282/308/364/399, 163/282/399/407, 163/282/407/ 449, 174, 198/282/308/342, 198/282/407, 198/308, 247, 248, 254, 258, 282/308/342/364/449, 282/308/449, 365, 389, 401/402, 416, 427, 429, 432, 433, and 456, wherein the positions are numbered with reference to SEQ ID NO: 5976. In some embodiments, the polypeptide sequence of the engineered glycosyltransferase comprises at least one mutation or mutation set at one or more positions selected from 2P/4T/14I/158D/282S/364A/449R, 2P/4T/14I/158D/282S/ 407V, 2P/4T/14I/163A/198E, 2P/4T/14I/163A/282S/399D, 2P/4T/14I/198E/308L/407V, 2P/4T/14I/282S/308L/364A, 2P/4T/14I/282S/308L/407V, 2P/4T/14I/282S/364A, 2P/4T/ 158D/163A/364A/399D/407V, 2P/4T/158D/198E/282S/ 364A/407V, 2P/4T/163A/198E/282S/308L/342W, 2P/4T/ 163A/282S/342W/364A, 2P/4T/163A/364A/399D/449R, 2P/4T/198E/282S/449R, 2P/4T/198E/364A/391C/449R, 2P/4T/282S/342W/364A/407V, 2P/14I/158D/198E/407V/ 449R, 2P/14I/163A/308L/364A, 2P/14I/163A/364A/407V, 2P/14I/282S, 2P/14I/282S/308L, 2P/14I/282S/308L/364A, 2P/14I/282S/399D, 2P/14I/308L, 2P/14I/308L/364A, 2P/158D/163A/407V/449R, 2P/163A/282S, 2P/163A/282S/ 308L/364A, 2P/198E/282S/308L/342W, 2P/198E/282S/ 399D, 2P/282S, 2P/282S/308L/342W/407V, 2P/282S/308L/ 391C/407V, 2P/282S/399D, 2P/282S/399D/407V, 2P/308L, 2P/308L/364A/399D, 4T/14I/158D/163A/198E/282S/407V, 4T/14I/158D/282S/364A/391C/407V, 4T/14I/163A/282S, 4T/14I/163A/282S/308L/342W/407V/449R, 4T/14I/198E/ 308L/364A, 4T/14I/282S, 4T/14I/282S/308L/364A/407V/ 449R, 4T/14I/282S/342W/399D/407V, 4T/14I/364A/391C, 4T/158D/282S/364A/399D, 4T/163A/282S/308L/407V, 4T/198E/399D/407V, 4T/282S/342W/364A/407V, 4T/282S/364A/407V, 4T/364A, 12S, 14I/158D/163A/198E/ 364A, 14I/158D/163A/282S/364A, 14I/158D/198E/282S/ 342W/364A/449R, 14I/158D/364A, 14I/163A/198E/282S/ 342W/364A/449R, 14I/163A/282S/308L, 14I/282S, 14I/ 282S/308L, 14I/282S/342W/364A/391C, 14I/282S/364A, 14I/282S/364A/391C/407V/449R, 14I/282S/399D/407V/ 449R, 14I/407V, 37R, 44V, 70K, 71L/331K, 74H, 75G, 75M, 90Q, 90S, 90T, 106Y, 108H, 112N, 114P, 115R, 131V, 138V, 139A, 139R, 139, 156C, 158D/282S/407V, 158D/ 282S/407V/449R, 158D/364A/399D/407V/449R, 158D/ 364A/449R, 162A, 163A/198E/282S/342W, 163A/282S/ 308L/364A/399D, 163A/282S/399D/407V, 163A/282S/

407V/449R, 174P, 198E/282S/308L/342W, 198E/282S/ 407V, 198E/308L, 247C, 247L, 248C, 248L, 248W, 254Q, 258N, 282S/308L/342W/364A/449R, 282S/308L/449R, 365I, 389A, 389E, 389S, 401F/402L, 416L, 427K, 427R, 429W, 432L, 433L, and 456R, wherein the positions are numbered with reference to SEQ ID NO: 5976. In some embodiments, the polypeptide sequence of the engineered glycosyltransferase comprises at least one mutation or mutation set at one or more positions selected from E2P/K4T/ V14I/P158D/T282S/G364A/S449R, E2P/K4T/V14I/ P158D/T282S/E407V, E2P/K4T/V14I/L163A/D198E, E2P/ K4T/V14I/L163A/T282S/N399D, E2P/K4T/V14I/D198E/ R308L/E407V, E2P/K4T/V14I/T282S/R308L/G364A, E2P/ K4T/V14I/T282S/R308L/E407V, E2P/K4T/V14I/T282S/ G364A, E2P/K4T/P158D/L163A/G364A/N399D/E407V, E2P/K4T/P158D/D198E/T282S/G364A/E407V, E2P/K4T/ L163A/D198E/T282S/R308L/E342W, E2P/K4T/L163A/ T282S/E342W/G364A, E2P/K4T/L163A/G364A/N399D/ S449R, E2P/K4T/D198E/T282S/S449R, E2P/K4T/D198E/ G364A/L391C/S449R, E2P/K4T/T282S/E342W/G364A/ E407V, E2P/V14I/P158D/D198E/E407V/S449R, E2P/ V14I/L163A/R308L/G364A, E2P/V14I/L163A/G364A/ E407V, E2P/V14I/T282S, E2P/V14I/T282S/R308L, E2P/ V14I/T282S/R308L/G364A, E2P/V14I/T282S/N399D, E2P/V14I/R308L, E2P/V14I/R308L/G364A, E2P/P158D/ L163A/E407V/S449R, E2P/L163A/T282S, E2P/L163A/ T282S/R308L/G364A, E2P/D198E/T282S/R308L/E342W, E2P/D198E/T282S/N399D, E2P/T282S, E2P/T282S/ R308L/E342W/E407V, E2P/T282S/R308L/L391C/E407V, E2P/T282S/N399D, E2P/T282S/N399D/E407V, E2P/ R308L, E2P/R308L/G364A/N399D, K4T/V14I/P158D/ L163A/D198E/T282S/E407V, K4T/V14I/P158D/T282S/ G364A/L391C/E407V, K4T/V14I/L163A/T282S, K4T/ V14I/L163A/T282S/R308L/E342W/E407V/S449R, K4T/ V14I/D198E/R308L/G364A, K4T/V14I/T282S, K4T/V14I/ T282S/R308L/G364A/E407V/S449R, K4T/V14I/T282S/ E342W/N399D/E407V, K4T/V14I/G364A/L391C, K4T/ P158D/T282S/G364A/N399D, K4T/L163A/T282S/R308L/ E407V, K4T/D198E/N399D/E407V, K4T/T282S/E342W/ G364A/E407V, K4T/T282S/G364A/E407V, K4T/G364A, R12S, V14I/P158D/L163A/D198E/G364A, V14I/P158D/ L163A/T282S/G364A, V14I/P158D/D198E/T282S/ E342W/G364A/S449R, V14I/P158D/G364A, V14I/L163A/ D198E/T282S/E342W/G364A/S449R, V14I/L163A/ T282S/R308L, V14I/T282S, V14I/T282S/R308L, V14I/ T282S/E342W/G364A/L391C, V14I/T282S/G364A, V14I/ T282S/G364A/L391C/E407V/S449R, V14I/T282S/N399D/ E407V/S449R, V14I/E407V, S37R, I44V, P70K, Q71L/ R331K, W74H, L75G, L75M, P90Q, P90S, P90T, S106Y, M108H, P112N, D114P, E115R, P131V, L138V, P139A, P139R, P139S, S156C, P158D/T282S/E407V, P158D/ T282S/E407V/S449R, P158D/G364A/N399D/E407V/ S449R, P158D/G364A/S449R, E162A, L163A/D198E/ T282S/E342W, L163A/T282S/R308L/G364A/N399D, L163A/T282S/N399D/E407V, L163A/T282S/E407V/ S449R, L174P, D198E/T282S/R308L/E342W, D198E/ T282S/E407V, D198E/R308L, K247C, K247L, H248C, H248L, H248W, S254Q, D258N, T282S/R308L/E342W/ G364A/S449R, T282S/R308L/S449R, V365I, D389A, D389E, D389S, L401F/E402L, D416L, D416S, A427K, A427R, L429W, K432L, A433L, and S456R, wherein the positions are numbered with reference to SEQ ID NO: 5976. In some embodiments, the polypeptide sequence of the engineered glycosyltransferase comprises a sequence at least 95% identical to any of SEQ ID NOS: 6016, 6018, 6020, 6022, 6024, 6026, 6028, 6030, 6032, 6034, 6036, 6038, 6040, 6042, 6044, 6046, 6048, 6050, 6052, 6054, 6056, 6058, 6060, 6062, 6064, 6066, 6068, 6070, 6072, 6074, 6076, 6078, 6080, 6082, 6084, 6086, 6088, 6090, 6092, 6094, 6096, 6098, 6100, 6102, 6104, 6106, 6108, 6110, 6112, 6114, 6116, 6118, 6120, 6122, 6124, 6126, 6128, 6130, 6132, 6134, 6136, 6138, 6140, 6142, 6144, 6146, 6148, 6150, 6152, 6154, 6156, 6158, 6160, 6162, 6164, 6166, 6168, 6170, 6172, 6174, 6176, 6178, 6180, 6182, 6184, 6186, 6188, 6190, 6192, 6194, 6196, 6198, 6200, 6202, 6204, 6206, 6208, 6210, 6212, 6214, 6216, 6218, 6220, 6222, 6224, 6226, 6228, 6230, 6232, 6234, 6236, 6238, 6240, 6242, 6244, 6246, 6248, 6250, 6252, 6254, 6256, 6258, and 6260. In some embodiments, the polypeptide sequence of the engineered glycosyltransferase comprises any of SEQ ID NOS: 6016, 6018, 6020, 6022, 6024, 6026, 6028, 6030, 6032, 6034, 6036, 6038, 6040, 6042, 6044, 6046, 6048, 6050, 6052, 6054, 6056, 6058, 6060, 6062, 6064, 6066, 6068, 6070, 6072, 6074, 6076, 6078, 6080, 6082, 6084, 6086, 6088, 6090, 6092, 6094, 6096, 6098, 6100, 6102, 6104, 6106, 6108, 6110, 6112, 6114, 6116, 6118, 6120, 6122, 6124, 6126, 6128, 6130, 6132, 6134, 6136, 6138, 6140, 6142, 6144, 6146, 6148, 6150, 6152, 6154, 6156, 6158, 6160, 6162, 6164, 6166, 6168, 6170, 6172, 6174, 6176, 6178, 6180, 6182, 6184, 6186, 6188, 6190, 6192, 6194, 6196, 6198, 6200, 6202, 6204, 6206, 6208, 6210, 6212, 6214, 6216, 6218, 6220, 6222, 6224, 6226, 6228, 6230, 6232, 6234, 6236, 6238, 6240, 6242, 6244, 6246, 6248, 6250, 6252, 6254, 6256, 6258, and 6260.

The present invention also provides engineered glycosyltransferases, wherein the polypeptide sequences of the engineered glycosyltransferases comprise at least one mutation or mutation set at one or more positions selected from 14/113/158, 14/113/158/163, 14/113/158/163/190/257/308/ 342, 14/113/158/163/437, 14/113/158/308/317/330/449, 14/113/163/190/308/317, 14/113/163/257/308/342/437/449, 14/113/163/257/437, 14/113/163/308/317/320/322/330/449, 14/113/320/437/449, 14/158, 14/158/163/190/257/308/317/ 330/437, 14/158/163/190/342/437, 14/158/163/257, 14/158/ 163/257/308/449, 14/158/257/308/437/449, 14/158/317/ 320/330/437, 14/163/317/320, 14/190, 14/190/257/317/320/ 322, 14/257/308/320/322/330, 14/257/308/322/330/437, 14/317, 14/330, 14/449, 19, 29/375, 41, 45, 46, 71, 72, 80, 81, 83, 84, 85, 88, 95, 105, 113/158/163/190/257/437, 113/158/163/190/308/317/322, 113/158/163/190/308/320, 113/158/163/257/308/317/322/437/449, 113/158/190/257/ 320, 113/158/190/320/322/449, 113/158/320/322/437, 113/ 257/308, 113/257/317/322/437, 155, 158/163, 158/163/190/ 257/308/342/449, 158/163/308, 158/163/322/437, 158/308/ 320/437, 158/320/437/449, 163/308/330/437/449, 168, 190/ 449, 197, 199, 202, 209, 243, 249, 263, 273, 317/320/322/ 330, 322/330, 366, 375, and 383, wherein the positions are numbered with reference to SEQ ID NO: 6138.

In some embodiments, the polypeptide sequence of the engineered glycosyltransferase comprises at least one mutation or mutation set at one or more positions selected from 14I/113S/158P, 14I/113S/158P/163A, 14I/113S/158P/163A/ 190R/257Q/308L/342W, 14I/113S/158P/163A/437I, 14I/ 113S/158P/308L/317R/330D/449R, 14I/113S/163A/190R/ 308L/317R, 14I/113S/163A/257Q/308L/342W/437I/449R, 14I/113S/163A/257Q/437I, 14I/113S/163A/308L/317R/ 320I/322L/330D/449R, 14I/113S/320I/437I/449R, 14I/ 158P, 14I/158P/163A/190R/257Q/308L/317R/330D/437I, 14I/158P/163A/190R/342W/437I, 14I/158P/163A/257Q, 14I/158P/163A/257Q/308L/449R, 14I/158P/257Q/308L/ 437I/449R, 14I/158P/317R/320I/330D/437I, 14I/163A/ 317R/320I, 14I/190R, 14I/190R/257Q/317R/320I/322L, 14I/257Q/308L/320I/322L/330D, 14I/257Q/308L/322L/

330D/437I, 14I/317R, 14I/330D, 14I/449R, 19Q, 29M/ 375P, 41A, 45L, 46S, 71V, 72S, 72T, 80P, 81T, 83A, 83K, 83N, 83S, 83T, 84D, 84H, 84N, 85L, 88A, 88C, 88H, 88K, 88T, 95N, 105A, 113S/158P/163A/190R/257Q/437I, 113S/ 158P/163A/190R/308L/317R/322L, 113S/158P/163A/ 190R/308L/320I, 113S/158P/163A/257Q/308L/317R/322L/ 437I/449R, 113S/158P/190R/257Q/320I, 113S/158P/190R/ 320I/322L/449R, 113S/158P/320I/322L/437I, 113S/257Q/ 308L, 113S/257Q/317R/322L/437I, 155L, 158P/163A, 158P/163A/190R/257Q/308L/342W/449R, 158P/163A/ 308L, 158P/163A/322L/437I, 158P/308L/320/437I, 158P/ 320/437I/449R, 163A/308L/330D/437I/449R, 168C, 168T, 190R/449R, 197K, 199E, 199H, 199M, 199Q, 199Y, 202H, 202Q, 202T, 202V, 209T, 243I, 249S, 263T, 273A, 273H, 273R, 317R/320I/322L/330D, 322L/330D, 366C, 366L, 366S, 366T, 366V, 375A, 375P, 375T, 375V, and 383V, wherein the positions are numbered with reference to SEQ ID NO: 6138. In some embodiments, the polypeptide sequence of the engineered glycosyltransferase comprises at least one mutation or mutation set at one or more positions selected from V14I/E113S/D158P, V14I/E113S/D158P/ L163A, V14I/E113S/D158P/L163A/K190R/L257Q/ R308L/E342W, V14I/E113S/D158P/L163A/L437I, V14I/ E113S/D158P/R308L/S317R/E330D/S449R, V14I/E113S/ L163A/K190R/R308L/S317R, V14I/E113S/L163A/L257Q/ R308L/E342W/L437I/S449R, V14I/E113S/L163A/L257Q/ L437I, V14I/E113S/L163A/R308L/S317R/V320I/P322L/ E330D/S449R, V14I/E113S/V320I/L437I/S449R, V14I/ D158P, V14I/D158P/L163A/K190R/L257Q/R308L/S317R/ E330D/L437I, V14I/D158P/L163A/K190R/E342W/L437I, V14I/D158P/L163A/L257Q, V14I/D158P/L163A/L257Q/ R308L/S449R, V14I/D158P/L257Q/R308L/L437I/S449R, V14I/D158P/S317R/V320I/E330D/L437I, V14I/L163A/ S317R/V320I, V14I/K190R, V14I/K190R/L257Q/S317R/ V320I/P322L, V14I/L257Q/R308L/V320I/P322L/E330D, V14I/L257Q/R308L/P322L/E330D/L437I, V14I/S317R, V14I/E330D, V14I/S449R, V19Q, L29M/D375P, S41A, F45L, H46S, Q71V, D72S, D72T, T80P, H81T, P83A, P83K, P83N, P83S, P83T, G84D, G84H, G84N, A85L, R88A, R88C, R88H, R88K, R88T, H95N, E105A, E113S/D158P/ L163A/K190R/L257Q/L437I, E113S/D158P/L163A/ K190R/R308L/S317R/P322L, E113S/D158P/L163A/ K190R/R308L/V320I, E113S/D158P/L163A/L257Q/ R308L/S317R/P322L/L437I/S449R, E113S/D158P/ K190R/L257Q/V320I, E113S/D158P/K190R/V320I/ P322L/S449R, E113S/D158P/V320I/P322L/L437I, E113S/ L257Q/R308L, E113S/L257Q/S317R/P322L/L437I, V155L, D158P/L163A, D158P/L163A/K190R/L257Q/ R308L/E342W/S449R, D158P/L163A/R308L, D158P/ L163A/P322L/L437I, D158P/R308L/V320I/L437I, D158P/ V320I/L437I/S449R, L163A/R308L/E330D/L437I/S449R, P168C, P168T, K190R/S449R, Q197K, A199E, A199H, A199M, A199Q, A199Y, I202H, I202Q, I202T, I202V, E209T, L243I, Y249S, V263T, S273A, S273H, S273R, S317R/V320I/P322L/E330D, P322L/E330D, A366C, A366L, A366S, A366T, A366V, D375A, D375P, D375T, D375V, and N383V, wherein the positions are numbered with reference to SEQ ID NO: 6138.

In some embodiments, the polypeptide sequence of the engineered glycosyltransferase comprises a sequence at least 90% identical to any of SEQ ID NOS: 6262, 6264, 6266, 6268, 6270, 6272, 6274, 6276, 6278, 6280, 6282, 6284, 6286, 6288, 6290, 6292, 6294, 6296, 6298, 6300, 6302, 6304, 6306, 6308, 6310, 6312, 6314, 6316, 6318, 6320, 6322, 6324, 6326, 6328, 6330, 6332, 6334, 6336, 6338, 6340, 6342, 6344, 6346, 6348, 6350, 6352, 6354, 6356, 6358, 6360, 6362, 6364, 6366, 6368, 6370, 6372, 6374, 6376, 6378, 6380, 6382, 6384, 6386, 6388, 6390, 6392, 6394, 6396, 6398, 6400, 6402, 6404, 6406, 6408, 6410, 6412, 6414, 6416, 6418, 6420, 6422, 6424, 6426, 6428, 6430, 6432, 6434, 6436, 6438, 6440, 6442, 6444, 6446, 6448, 6450, 6452, 6454, 6456, 6458, and 6460. In some embodiments, the polypeptide sequence of the engineered glycosyltransferase comprises a sequence at least 95% identical to any of SEQ ID NOS: 6262, 6264, 6266, 6268, 6270, 6272, 6274, 6276, 6278, 6280, 6282, 6284, 6286, 6288, 6290, 6292, 6294, 6296, 6298, 6300, 6302, 6304, 6306, 6308, 6310, 6312, 6314, 6316, 6318, 6320, 6322, 6324, 6326, 6328, 6330, 6332, 6334, 6336, 6338, 6340, 6342, 6344, 6346, 6348, 6350, 6352, 6354, 6356, 6358, 6360, 6362, 6364, 6366, 6368, 6370, 6372, 6374, 6376, 6378, 6380, 6382, 6384, 6386, 6388, 6390, 6392, 6394, 6396, 6398, 6400, 6402, 6404, 6406, 6408, 6410, 6412, 6414, 6416, 6418, 6420, 6422, 6424, 6426, 6428, 6430, 6432, 6434, 6436, 6438, 6440, 6442, 6444, 6446, 6448, 6450, 6452, 6454, 6456, 6458, and 6460. In some embodiments, the polypeptide sequence of the engineered glycosyltransferase comprises any of SEQ ID NOS: 6262, 6264, 6266, 6268, 6270, 6272, 6274, 6276, 6278, 6280, 6282, 6284, 6286, 6288, 6290, 6292, 6294, 6296, 6298, 6300, 6302, 6304, 6306, 6308, 6310, 6312, 6314, 6316, 6318, 6320, 6322, 6324, 6326, 6328, 6330, 6332, 6334, 6336, 6338, 6340, 6342, 6344, 6346, 6348, 6350, 6352, 6354, 6356, 6358, 6360, 6362, 6364, 6366, 6368, 6370, 6372, 6374, 6376, 6378, 6380, 6382, 6384, 6386, 6388, 6390, 6392, 6394, 6396, 6398, 6400, 6402, 6404, 6406, 6408, 6410, 6412, 6414, 6416, 6418, 6420, 6422, 6424, 6426, 6428, 6430, 6432, 6434, 6436, 6438, 6440, 6442, 6444, 6446, 6448, 6450, 6452, 6454, 6456, 6458, and 6460.

The present invention also provides engineered glycosyltransferases, wherein the polypeptide sequences of the engineered glycosyltransferases comprise at least one mutation or mutation set at one or more positions selected from 37/71/125/174/247/248/427, 37/71/247/331/365/389/401/ 429, 37/139/329/365/427/433/449, 37/139/427/432/433/ 449, 37/139/429/432/433, 37/174/401/402/433/449, 37/248/ 331/389/427/433, 37/248/389/401/429, 37/331/432/433, 71/139/389/427/429/432/433/449, 71/174/329/427/429/ 432/433, 71/174/365/427/432, 71/248/365/389/401, 71/248/ 449, 71/254/433/449, 71/427/432/433/449, 71/432/433, 139/156/174/389/401/427/433/449, 139/156/247/365/401/ 433/449, 139/156/247/389/401/427/433/449, 139/156/248/ 389, 139/156/248/389/401/416/427/429/433, 139/156/365, 139/174/248/331/389/401/449, 139/174/254, 139/174/365/ 401/402/427/433/449, 139/247/248/331/401/417/432/449, 139/248/254/449, 139/248/402/416/427/433/449, 139/248/ 432/433, 139/254/401/416/427/433/449, 139/401/449, 156/ 248/256, 156/254/331/365/427/432/449, 156/389/401/402/ 416/432/433, 174/247/248/389/401/432/433, 174/329/432/ 449, 174/365, 174/389/429/432/433/449, 247/248/401, 247/ 248/449, 247/331/401/427/432/449, 247/401, 247/427/432, 248/331/427/429/433, 248/365/389/427/429/432/449, 248/ 401/429/432/433, 248/416, 248/416/449, 248/449, 254/365, 254/427/433, 331/365/429/432/433/449, 365/401/402/429/ 432/433, 389/401/416/432/449, 389/401/427/432, 401/427, 416/427/433/449, 416/432/433, 416/432/433/449, 427/432, 427/432/449, 432, and 433/449, wherein the positions are numbered with reference to SEQ ID NO: 6288. In some embodiments, the polypeptide sequence of the engineered glycosyltransferase comprises at least one mutation or mutation set at one or more positions selected from 37R/71L/ 125M/174P/247C/248W/427R, 37R/71L/247C/331K/365I/ 389E/401F/429W, 37R/139K/329P/365I/427R/433L/449R, 37R/139K/427R/432L/433L/449R, 37R/139K/429W/432L/

433L, 37R/174P/401F/402L/433L/449R, 37R/248W/331K/ 389E/427R/433L, 37R/248W/389A/401F/429W, 37R/ 331K/432L/433L, 71L/139K/389A/427R/429W/432L/ 433L/449R, 71L/174P/329P/427R/429W/432L/433L, 71L/ 174P/365I/427R/432L, 71L/248W/365I/389A/401F, 71L/ 248W/449R, 71L/254Q/433L/449R, 71L/427R/432L/ 433L449R, 71L/432L/433L, 139K/156C/174P/389E/401F/ 427R/433L/449R, 139K/156C/247C/365I/401F/433L/ 449R, 139K/156C/247L/389E/401F/427R/433L/449R, 139K/156C/248W/389A/401F/416S/427R/429W/433L, 139K/156C/248W/389E, 139K/156C/365I, 139K/174P/ 248W/331K/389A/401F/449R, 139K/174P/254Q, 139K/ 174P/365I/401F/402L/427R/433L/449R, 139K/247C/ 248W/331K/401F/417Q/432L/449R, 139K/248W/254A/ 449R, 139K/248W/402L/416L/427R/433L/449R, 139K/ 248W/432L/433L, 139K/254Q/401F/416S/427R/433L/ 449R, 139K/401F/449R, 156C/248W/256M, 156C/254Q/ 331K/365I/427R/432L/449R, 156C/389E/401F/402L/ 416L/432L/433L, 174P/247C/248W/389A/401F/432L/ 433L, 174P/329P/432L/449R, 174P/365I, 174P/389E/ 429W/432L/433L/449R, 247C/248W/401F, 247C/331K/ 401F/427R/432L/449R, 247C/427R/432L, 247L/248W/ 449R, 247L/401F, 248W/331K/427R/429W/433L, 248W/ 365I/389E/427R/429W/432L/449R, 248W/401F/429W/ 432L/433L, 248W/416L, 248W/416L/449R, 248W/449R, 254Q/365I, 254Q/427R/433L, 331K/365I/429W/432L/ 433L/449R, 365I/401F/402L/429W/432L/433L, 389A/ 401F/416S/432L/449R, 389E/401F/427R/432L, 401F/ 427R, 416L/427R/433L/449R, 416L/432L/433L/449R, 416S/432L/433L, 427R/432L, 427R/432L/449R, 432L, and 433L/449R, wherein the positions are numbered with reference to SEQ ID NO: 6288. In some embodiments, the polypeptide sequence of the engineered glycosyltransferase comprises at least one mutation or mutation set at one or more positions selected from S37R/Q71L/L125M/L174P/ K247C/H248W/A427R, S37R/Q71L/K247C/R331K/ V365I/D389E/L401F/L429W, S37R/P139K/G329P/V365I/ A427R/A433L/S449R, S37R/P139K/A427R/K432L/ A433L/S449R, S37R/P139K/L429W/K432L/A433L, S37R/L174P/L401F/E402L/A433L/S449R, S37R/H248W/ R331K/D389E/A427R/A433L, S37R/H248W/D389A/ L401F/L429W, S37R/R331K/K432L/A433L, Q71L/ P139K/D389A/A427R/L429W/K432L/A433L/S449R, Q71L/L174P/G329P/A427R/L429W/K432L/A433L, Q71L/L174P/V365I/A427R/K432L, Q71L/H248W/V365I/ D389A/L401F, Q71L/H248W/S449R, Q71L/S254Q/ A433L/S449R, Q71L/A427R/K432L/A433L/S449R, Q71L/K432L/A433L, P139K/S156C/L174P/D389E/ L401F/A427R/A433L/S449R, P139K/S156C/K247C/ V365I/L401F/A433L/S449R, P139K/S156C/K247L/ D389E/L401F/A427R/A433L/S449R, P139K/S156C/ H248W/D389A/L401F/D416S/A427R/L429W/A433L, P139K/S156C/H248W/D389E, P139K/S156C/V365I, P139K/L174P/H248W/R331K/D389A/L401F/S449R, P139K/L174P/S254Q, P139K/L174P/V365I/L401F/ E402L/A427R/A433L/S449R, P139K/K247C/H248W/ R331K/L401F/P417Q/K432L/S449R, P139K/H248W/ S254A/S449R, P139K/H248W/E402L/D416L/A427R/ A433L/S449R, P139K/H248W/K432L/A433L, P139K/ S254Q/L401F/D416S/A427R/A433L/S449R, P139K/ L401F/S449R, S156C/H248W/L256M, S156C/S254Q/ R331K/V365I/A427R/K432L/S449R, S156C/D389E/ L401F/E402L/D416L/K432L/A433L, L174P/K247C/ H248W/D389A/L401F/K432L/A433L, L174P/G329P/ K432L/S449R, L174P/V365I, L174P/D389E/L429W/ K432L/A433L/S449R, K247C/H248W/L401F, K247C/ R331K/L401F/A427R/K432L/S449R, K247C/A427R/ K432L, K247L/H248W/S449R, K247L/L401F, H248W/ R331K/A427R/L429W/A433L, H248W/V365I/D389E/ A427R/L429W/K432L/S449R, H248W/L401F/L429W/ K432L/A433L, H248W/D416L, H248W/D416L/S449R, H248W/S449R, S254Q/V365I, S254Q/A427R/A433L, R331K/V365I/L429W/K432L/A433L/S449R, V365I/ L401F/E402L/L429W/K432L/A433L, D389A/L401F/ D416S/K432L/S449R, D389E/L401F/A427R/K432L, L401F/A427R, D416L/A427R/A433L/S449R, D416L/ K432L/A433L/S449R, D416S/K432L/A433L, A427R/ K432L, A427R/K432L/S449R, K432L, and A433L/S449R, wherein the positions are numbered with reference to SEQ ID NO: 6288. In some embodiments, the polypeptide sequence of the engineered glycosyltransferase comprises at least one mutation or mutation set at one or more positions selected from 5/449, 6, 10, 25, 25/449, 69, 69/449, 87, 87/449, 91, 91/449, 144/449, 153, 153/449, 159, 159/449, 172, 172/449, 212/449, 233, 233/449, 288/449, 303, 317, 347/449, 361, 369, and 421, wherein the positions are numbered with reference to SEQ ID NO: 6288. In some embodiments, the polypeptide sequence of the engineered glycosyltransferase comprises at least one mutation or mutation set at one or more positions selected from 5S/449R, 6P, 10K, 25I/449R, 25M/449R, 25Q/449R, 25S, 69A, 69M/ 449R, 87A/449R, 87E, 87K, 87Q, 87R, 91L, 91N/449R, 91Q, 91T/449R, 91V, 144Q/449R, 153T/449R, 153V, 159K, 159R/449R, 172S, 172T/449R, 212L/449R, 233A, 233C, 233G, 233L/449R, 233M/449R, 233Q/449R, 233R, 233S, 233V, 288P/449R, 303C, 303V, 317Y, 347P/449R, 361C, 369K, and 421, wherein the positions are numbered with reference to SEQ ID NO: 6288. In some embodiments, the polypeptide sequence of the engineered glycosyltransferase comprises at least one mutation or mutation set at one or more positions selected from T5S/S449R, E6P, R10K, L25I/ S449R, L25M/S449R, L25Q/S449R, L25S, D69A, D69M/ S449R, M87A/S449R, M87E, M87K, M87Q, M87R, I91L, I91N/S449R, I91Q, I91T/S449R, I91V, M144Q/S449R, A153T/S449R, A153V, Q159K, Q159R/S449R, H172S, H172T/S449R, A212L/S449R, W233A, W233C, W233G, W233L/S449R, W233M/S449R, W233Q/S449R, W233R, W233S, W233V, E288P/S449R, Q303C, Q303V, S317Y, K347P/S449R, T361C, V369K, and V421I, wherein the positions are numbered with reference to SEQ ID NO: 6288. In some embodiments, the polypeptide sequence of the engineered glycosyltransferase comprises a sequence at least 90% identical to any of SEQ ID NOS: 6462, 6464, 6466, 6468, 6470, 6472, 6474, 6476, 6478, 6480, 6482, 6484, 6486, 6488, 6490, 6492, 6494, 6496, 6498, 6500, 6502, 6504, 6506, 6508, 6510, 6512, 6514, 6516, 6518, 6520, 6522, 6524, 6526, 6528, 6530, 6532, 6534, 6536, 6538, 6540, 6542, 6544, 6546, 6548, 6550, 6552, 6554, 6556, 6558, 6560, 6562, 6564, 6566, 6568, 6570, 6572, 6574, 6576, 6578, 6580, 6582, 6584, 6586, 6588, 6590, 6592, 6594, 6596, 6598, 6600, 6602, 6604, 6606, 6608, 6610, 6612, 6614, 6616, 6618, 6620, 6622, 6624, 6626, 6628, 6630, 6632, 6634, 6636, 6638, 6640, 6642, 6644, 6646, 6648, 6650, 6652, 6654, 6656, 6658, 6660, 6662, 6664, 6666, 6668, 6670, 6672, 6674, and 6676. In some embodiments, the polypeptide sequence of the engineered glycosyltransferase comprises a sequence at least 95% identical to any of SEQ ID NOS: 6462, 6464, 6466, 6468, 6470, 6472, 6474, 6476, 6478, 6480, 6482, 6484, 6486, 6488, 6490, 6492, 6494, 6496, 6498, 6500, 6502, 6504, 6506, 6508, 6510, 6512, 6514, 6516, 6518, 6520, 6522, 6524, 6526, 6528, 6530, 6532, 6534, 6536, 6538, 6540, 6542, 6544, 6546, 6548, 6550, 6552, 6554, 6556, 6558, 6560, 6562, 6564, 6566, 6568, 6570, 6572, 6574, 6576, 6578, 6580, 6582, 6584, 6586, 6588, 6590, 6592, 6594, 6596, 6598, 6600, 6602, 6604, 6606, 6608, 6610, 6612, 6614, 6616, 6618, 6620, 6622, 6624, 6626, 6628, 6630, 6632, 6634, 6636, 6638, 6640, 6642, 6644, 6646, 6648, 6650, 6652, 6654, 6656, 6658, 6660, 6662, 6664, 6666, 6668, 6670, 6672, 6674, and 6676. In some embodiments, the polypeptide sequence of the engineered glycosyltransferase comprises any of SEQ ID NOS: 6462, 6464, 6466, 6468, 6470, 6472, 6474, 6476, 6478, 6480, 6482, 6484, 6486, 6488, 6490, 6492, 6494, 6496, 6498, 6500, 6502, 6504, 6506, 6508, 6510, 6512, 6514, 6516, 6518, 6520, 6522, 6524, 6526, 6528, 6530, 6532, 6534, 6536, 6538, 6540, 6542, 6544, 6546, 6548, 6550, 6552, 6554, 6556, 6558, 6560, 6562, 6564, 6566, 6568, 6570, 6572, 6574, 6576, 6578, 6580, 6582, 6584, 6586, 6588, 6590, 6592, 6594, 6596, 6598, 6600, 6602, 6604, 6606, 6608, 6610, 6612, 6614, 6616, 6618, 6620, 6622, 6624, 6626, 6628, 6630, 6632, 6634, 6636, 6638, 6640, 6642, 6644, 6646, 6648, 6650, 6652, 6654, 6656, 6658, 6660, 6662, 6664, 6666, 6668, 6670, 6672, 6674, and 6676.

The present invention also provides engineered glycosyltransferases, wherein the polypeptide sequences of the engineered glycosyltransferases comprise at least one mutation or mutation set at one or more positions selected from 37/41/45/72/81/83/84/88/155/163/168/190/331/375, 37/41/45/72/81/83/84/88/155/263/273/331/375/432, 37/41/45/72/81/83/84/88/155/331/366/375, 37/41/45/72/81/83/84/88/155/331/375, 37/41/45/72/81/83/84/88/248/375, 37/41/45/72/81/83/84/88/331/366/432/433, 37/41/45/72/88/155/168/190/331/366/375/432, 37/41/45/72/88/155/168/190/331/375, 37/41/45/72/88/190/263/273/331/366, 37/41/45/72/155/163/168/190/243/263/273/331/366/432, 37/41/45/72/155/163/168/243/248/273/331/366/432/433, 37/41/45/72/155/163/168/263/366/432/433, 37/41/45/72/155/163/331/366/375, 37/41/45/72/155/190/243/248/273/331/432/433, 37/41/45/72/155/190/248/263/331, 37/41/45/72/155/190/263/331/366, 37/41/45/72/155/190/273/331/366/375, 37/41/45/72/155/190/273/366, 37/41/45/72/155/190/273/366/375/432, 37/41/45/72/155/248/263/273/366, 37/41/45/72/155/263/331/375, 37/41/45/72/155/263/375, 37/41/45/72/155/273/366, 37/41/45/72/155/331/366/375/432/433, 37/41/45/72/190/263/273/331, 37/41/45/72/190/331/366, 37/41/45/72/190/366, 37/41/45/72/263/331/366, 37/41/45/72/263/366/432/433, 37/41/45/72/331/366, 37/41/45/81/83/84/88/155/168/190/243/331/366, 37/41/45/81/83/84/88/155/168/331/375, 37/41/45/81/83/84/88/155/263/273/331/366, 37/41/45/81/83/84/88/163/168/263/273/331/366/375, 37/41/45/155/163/168/263/331/375, 37/41/45/155/168/248/273/331/375, 37/41/45/155/190/331/366/375, 37/41/45/155/366, 37/41/45/155/366/432/433, 37/41/45/155/375, 37/41/45/243/248/273/331, 37/41/45/263/331/375/432, 37/41/45/331/366/432/433, 37/72/81/83/88/155/190, 37/72/197/273/331/375/432, 37/83/263/365/366/375, 37/190/202, 41/45/72/155/263/331/366/375/432/433, 41/45/163/168/243/248/273/366/432, 45/72/84/88/197/375, 45/72/88/366, 45/72/163/202/365/366/375, 45/72/168/243/331/365/366/429/432, 45/84/168/190/199/254/273/365/366, 45/163/168/190/199/366/429/432, 45/163/168/197/263/331/365/366, 72/81/83/84/88/155/163/168/190/366, 72/81/83/84/88/155/190, 72/81/83/84/88/155/190/273/331/366/432, 72/81/83/84/88/155/273/331/375, 72/81/83/84/88/155/366, 72/81/83/84/88/163/168/190/243/263/331/366, 72/81/83/84/88/163/168/263/331/375, 72/81/84/190/248, 72/83/84/88/202/254/273/366/375, 72/83/84/197/202/243/263/365/366, 72/83/88/243/263/331/365/366, 72/155/163/168/190/366/432/433, 72/155/190, 72/155/190/263/331/366, 72/155/190/366, 72/155/273/331/375/432, 72/243/248/263/366/432/433, 72/243/248/273/366/432/433, 72/243/248/366/432/433, 72/248, 81/83/84/88/155/163/168/273/331/375, 81/83/84/88/155/190/263/331/366, 81/83/84/88/155/263/366/375, 81/83/84/88/155/366, 81/83/84/88/190/263/375, 81/83/84/88/263/273/331/366/432, 81/83/169/190/263, 81/83/190/263/365/366, 81/83/202/365/366/402, 81/88/375/402, 83/88/155/273/366/375, 84/155/168/197/199/331/366/375/383/402, 84/168/197/202/263/366, 84/197/366/402, 155/168/190/197/199/366, 155/168/375, 155/263/366/432/433, 190/199/202/331/366, 197/199/202, 197/202/248, 197/248, 199/263/331/365/366, 248/375, 365/366, and 365/375/402, wherein the positions are numbered with reference to SEQ ID NO: 6468. In some embodiments, the polypeptide sequence of the engineered glycosyltransferase comprises at least one mutation or mutation set at one or more positions selected from 37R/41A/45L/72T/81T/83S/84N/88T/155L/163A/168T/190R/331K/375P, 37R/41A/45L/72T/81T/83S/84N/88T/155L/263T/273R/331K/375P/432L, 37R/41A/45L/72T/81T/83S/84N/88T/155L/331K/366C/375P, 37R/41A/45L/72T/81T/83S/84N/88T/155L/331K/375P, 37R/41A/45L/72T/81T/83S/84N/88T/248W/375P, 37R/41A/45L/72T/81T/83S/84N/88T/331K/366V/432L/433A, 37R/41A/45L/72T/88T/155L/168T/190R/331K/366C/375P/432L, 37R/41A/45L/72T/88T/155L/168T/190R/331K/375P, 37R/41A/45L/72T/88T/190R/263T/273R/331K/366C, 37R/41A/45L/72T/155L/163A/168T/190R/243I/263T/273R/331K/366C/432L, 37R/41A/45L/72T/155L/163A/168T/243I/248W/273R/331K/366V/432L/433A, 37R/41A/45L/72T/155L/163A/168T/263T/366C/432L/433A, 37R/41A/45L/72T/155L/163A/331K/366C/375P, 37R/41A/45L/72T/155L/190R/243I/248W/273R/331K/432L/433A, 37R/41A/45L/72T/155L/190R/248W/263T/331K, 37R/41A/45L/72T/155L/190R/263T/331K/366C, 37R/41A/45L/72T/155L/190R/273R/331K/366V/375P, 37R/41A/45L/72T/155L/190R/273R/366C, 37R/41A/45L/72T/155L/190R/273R/366C/375P/432L, 37R/41A/45L/72T/155L/248W/263T/273R/366C, 37R/41A/45L/72T/155L/263T/331K/375P, 37R/41A/45L/72T/155L/263T/375P, 37R/41A/45L/72T/155L/273R/366C, 37R/41A/45L/72T/155L/331K/366V/375P/432L/433A, 37R/41A/45L/72T/190R/263T/273R/331K, 37R/41A/45L/72T/190R/331K/366C, 37R/41A/45L/72T/190R/366C, 37R/41A/45L/72T/263T/331K/366C, 37R/41A/45L/72T/263T/366C/432L/433A, 37R/41A/45L/72T/331K/366C, 37R/41A/45L/81T/83S/84N/88T/155L/168T/190R/243I/331K/366C, 37R/41A/45L/81T/83S/84N/88T/155L/168T/331K/375P, 37R/41A/45L/81T/83S/84N/88T/155L/263T/273R/331K/366C, 37R/41A/45L/81T/83S/84N/88T/163A/168T/263T/273R/331K/366C/375P, 37R/41A/45L/155L/163A/168T/263T/331K/375P, 37R/41A/45L/155L/168T/248W/273R/331K/375P, 37R/41A/45L/155L/190R/331K/366V/375P, 37R/41A/45L/155L/366C, 37R/41A/45L/155L/366C/432L/433A, 37R/41A/45L/155L/375P, 37R/41A/45L/243I/248W/273R/331K, 37R/41A/45L/263T/331K/375P/432L, 37R/41A/45L/331K/366V/432L/433A, 37R/72T/81T/83S/88T/155L/190R, 37R/72T/197K/273R/331K/375P/432L, 37R/83S/263T/365I/366V/375P, 37R/190R/202H, 41A/45L/72T/155L/263T/331K/366V/375P/432L/433A, 41A/45L/163A/168T/243I/248W/273R/366C/432L, 45L/72T/84N/88T/197K/375P, 45L/72T/88T/366C, 45L/72T/163A/202H/365I/366V/375P, 45L/72T/168T/243I/331K/365I/366C/429W/432L, 45L/84N/168T/190R/199Q/254A/273R/365I/366C, 45L/163A/168T/190R/199Q/366C/429W/432L, 45L/163A/168T/197K/263T/331K/365I/366C, 72T/81T/83S/84N/88T/155L/163A/168T/190R/366C, 72T/81T/83S/84N/88T/155L/190R, 72T/81T/83S/84N/88T/155L/190R/273R/331K/366V/432L, 72T/81T/83S/84N/88T/155L/273R/

331K/375P, 72T/81T/83S/84N/88T/155L/366C, 72T/81T/83S/84N/88T/163A/168T/190R/243I/263T/331K/366C, 72T/81T/83S/84N/88T/163A/168T/263T/331K/375P, 72T/81T/84N/190R/248W, 72T/83S/84N/88T/202H/254A/273R/366C/375P, 72T/83S/84N/197K/202H/243I/263T/365I/366C, 72T/83S/88T/243I/263T/331K/365I/366C, 72T/155L/163A/168T/190R/366V/432L/433A, 72T/155L/190R, 72T/155L/190R/263T/331K/366C, 72T/155L/190R/366C, 72T/155L/273R/331K/375P/432L, 72T/243I/248W/263T/366V/432L/433A, 72T/243I/248W/273R/366V/432L/433A, 72T/243I/248W/366V/432L/433A, 72T/248W, 81T/83S/84N/88T/155L/163A/168T/273R/331K/375P, 81T/83S/84N/88T/155L/190R/263T/331K/366C, 81T/83S/84N/88T/155L/263T/366V/375P, 81T/83S/84N/88T/155L/366C, 81T/83S/84N/88T/190R/263T/375P, 81T/83S/84N/88T/263T/273R/331K/366C/432L, 81T/83S/169D/190R/263T, 81T/83S/190R/263T/365I/366C, 81T/83S/202H/365I/366C/402L, 81T/88T/375P/402L, 83S/88T/155L/273R/366V/375P, 84N/155L/168T/197K/199Q/331K/366V/375P/383V/402L, 84N/168T/197K/202H/263T/366C, 84N/197K/366C/402L, 155L/168T/190R/197K/199Q/366C, 155L/168T/375P, 155L/263T/366C/432L/433A, 190R/199Q/202H/331K/366C, 197K/199Q/202H, 197K/202H/248W, 197K/248W, 199Q/263T/331K/365I/366C, 248W/375P, 365I/366C, and 365I/375P/402L, wherein the positions are numbered with reference to SEQ ID NO: 6468. In some embodiments, the polypeptide sequence of the engineered glycosyltransferase comprises at least one mutation or mutation set at one or more positions selected from S37R/S41A/F45L/D72T/H81T/P83S/G84N/R88T/V155L/L163A/P168T/K190R/R331K/D375P, S37R/S41A/F45L/D72T/H81T/P83S/G84N/R88T/V155L/V263T/S273R/R331K/D375P/K432L, S37R/S41A/F45L/D72T/H81T/P83S/G84N/R88T/V155L/R331K/A366C/D375P, S37R/S41A/F45L/D72T/H81T/P83S/G84N/R88T/V155L/R331K/D375P, S37R/S41A/F45L/D72T/H81T/P83S/G84N/R88T/H248W/D375P, S37R/S41A/F45L/D72T/H81T/P83S/G84N/R88T/R331K/A366V/K432L/L433A, S37R/S41A/F45L/D72T/R88T/V155L/P168T/K190R/R331K/A366C/D375P/K432L, S37R/S41A/F45L/D72T/R88T/V155L/P168T/K190R/R331K/D375P, S37R/S41A/F45L/D72T/R88T/K190R/V263T/S273R/R331K/A366C, S37R/S41A/F45L/D72T/V155L/L163A/P168T/K190R/L243I/V263T/S273R/R331K/A366C/K432L, S37R/S41A/F45L/D72T/V155L/L163A/P168T/L243I/H248W/S273R/R331K/A366V/K432L/L433A, S37R/S41A/F45L/D72T/V155L/L163A/P168T/V263T/A366C/K432L/L433A, S37R/S41A/F45L/D72T/V155L/L163A/R331K/A366C/D375P, S37R/S41A/F45L/D72T/V155L/K190R/L243I/H248W/S273R/R331K/K432L/L433A, S37R/S41A/F45L/D72T/V155L/K190R/H248W/V263T/R331K, S37R/S41A/F45L/D72T/V155L/K190R/V263T/R331K/A366C, S37R/S41A/F45L/D72T/V155L/K190R/S273R/R331K/A366V/D375P, S37R/S41A/F45L/D72T/V155L/K190R/S273R/A366C, S37R/S41A/F45L/D72T/V155L/K190R/S273R/A366C/D375P/K432L, S37R/S41A/F45L/D72T/V155L/H248W/V263T/S273R/A366C, S37R/S41A/F45L/D72T/V155L/V263T/R331K/D375P, S37R/S41A/F45L/D72T/V155L/V263T/D375P, S37R/S41A/F45L/D72T/V155L/S273R/A366C, S37R/S41A/F45L/D72T/V155L/R331K/A366V/D375P/K432L/L433A, S37R/S41A/F45L/D72T/K190R/V263T/S273R/R331K, S37R/S41A/F45L/D72T/K190R/R331K/A366C, S37R/S41A/F45L/D72T/V263T/R331K/A366C, S37R/S41A/F45L/D72T/V263T/A366C/K432L/L433A, S37R/S41A/F45L/D72T/R331K/A366C, S37R/S41A/F45L/H81T/P83S/G84N/R88T/V155L/P168T/K190R/L243I/R331K/A366C, S37R/S41A/F45L/H81T/P83S/G84N/R88T/V155L/P168T/R331K/D375P, S37R/S41A/F45L/H81T/P83S/G84N/R88T/V155L/V263T/S273R/R331K/A366C, S37R/S41A/F45L/H81T/P83S/G84N/R88T/L163A/P168T/V263T/S273R/R331K/A366C/D375P, S37R/S41A/F45L/V155L/L163A/P168T/V263T/R331K/D375P, S37R/S41A/F45L/V155L/P168T/H248W/S273R/R331K/D375P, S37R/S41A/F45L/V155L/K190R/R331K/A366V/D375P, S37R/S41A/F45L/V155L/A366C, S37R/S41A/F45L/V155L/A366C/K432L/L433A, S37R/S41A/F45L/V155L/D375P, S37R/S41A/F45L/L243I/H248W/S273R/R331K, S37R/S41A/F45L/V263T/R331K/D375P/K432L, S37R/S41A/F45L/R331K/A366V/K432L/L433A, S37R/D72T/H81T/P83S/R88T/V155L/K190R, S37R/D72T/Q197K/S273R/R331K/D375P/K432L, S37R/P83S/V263T/V365I/A366V/D375P, S37R/K190R/I202H, S41A/F45L/D72T/V155L/V263T/R331K/A366V/D375P/K432L/L433A, S41A/F45L/L163A/P168T/L243I/H248W/S273R/A366C/K432L, F45L/D72T/G84N/R88T/Q197K/D375P, F45L/D72T/R88T/A366C, F45L/D72T/L163A/I202H/V365I/A366V/D375P, F45L/D72T/P168T/L243I/R331K/V365I/A366C/L429W/K432L, F45L/G84N/P168T/K190R/A199Q/S254A/S273R/V365I/A366C, F45L/L163A/P168T/K190R/A199Q/A366C/L429W/K432L, F45L/L163A/P168T/Q197K/V263T/R331K/V365I/A366C, D72T/H81T/P83S/G84N/R88T/V155L/L163A/P168T/K190R/A366C, D72T/H81T/P83S/G84N/R88T/V155L/K190R, D72T/H81T/P83S/G84N/R88T/V155L/K190R/S273R/R331K/A366V/K432L, D72T/H81T/P83S/G84N/R88T/V155L/S273R/R331K/D375P, D72T/H81T/P83S/G84N/R88T/V155L/A366C, D72T/H81T/P83S/G84N/R88T/L163A/P168T/K190R/L243I/V263T/R331K/A366C, D72T/H81T/P83S/G84N/R88T/L163A/P168T/V263T/R331K/D375P, D72T/H81T/G84N/K190R/H248W, D72T/P83S/G84N/R88T/I202H/S254A/S273R/A366C/D375P, D72T/P83S/G84N/Q197K/I202H/L243I/V263T/V365I/A366C, D72T/P83S/R88T/L243I/V263T/R331K/V365I/A366C, D72T/V155L/L163A/P168T/K190R/A366V/K432L/L433A, D72T/V155L/K190R, D72T/V155L/K190R/V263T/R331K/A366C, D72T/V155L/K190R/A366C, D72T/V155L/S273R/R331K/D375P/K432L, D72T/L243I/H248W/V263T/A366V/K432L/L433A, D72T/L243I/H248W/S273R/A366V/K432L/L433A, D72T/L243I/H248W/A366V/K432L/L433A, D72T/H248W, H81T/P83S/G84N/R88T/V155L/L163A/P168T/S273R/R331K/D375P, H81T/P83S/G84N/R88T/V155L/K190R/V263T/R331K/A366C, H81T/P83S/G84N/R88T/V155L/V263T/A366V/D375P, H81T/P83S/G84N/R88T/V155L/A366C, H81T/P83S/G84N/R88T/K190R/V263T/D375P, H81T/P83S/G84N/R88T/V263T/S273R/R331K/A366C/K432L, H81T/P83S/E169D/K190R/V263T, H81T/P83S/K190R/V263T/V365I/A366C, H81T/P83S/I202H/V365I/A366C/E402L, H81T/R88T/D375P/E402L, P83S/R88T/V155L/S273R/A366V/D375P, G84N/V155L/P168T/Q197K/A199Q/R331K/A366V/D375P/N383V/E402L, G84N/P168T/Q197K/I202H/V263T/A366C, G84N/Q197K/A366C/E402L, V155L/P168T/K190R/Q197K/A199Q/A366C, V155L/P168T/D375P, V155L/V263T/A366C/K432L/L433A, K190R/A199Q/I202H/R331K/A366C, Q197K/A199Q/I202H, Q197K/I202H/H248W, Q197K/H248W, A199Q/V263T/R331K/V365I/A366C, H248W/D375P, V365I/A366C, and V365I/D375P/E402L, wherein the positions are numbered with reference to SEQ ID NO: 6468. In some embodiments, the polypeptide sequence of the engineered glycosyltransferase comprises at least one mutation or mutation set at one or more positions selected from 2, 3, 4, 9, 53/437, 61, 64, 72/170, 72/405, 94, 96, 98, 113, 118, 118/120, 120, 129, 134/158, 158, 165, 170, 171, 173, 183, 193, 214, 214/222, 222, 226, 229, 234, 253, 265, 269, 272, 289, 296, 300, 302, 304, 322, 322/407, 330, 390, 395/439, 396, 398, 399, 403, 405, 408, 411, 412, 423, 428, 434, 435, 438, 439, 442, 444, 448, 449, 452, and 454, wherein the positions are numbered with reference to SEQ ID NO: 6468. In some embodiments, the polypeptide sequence of the engineered glycosyltransferase comprises at least one mutation or mutation set at one or more positions selected from 2F, 2H, 2K, 2M, 2Q, 2R, 2V, 3F, 3L, 3M, 4N, 4S, 9A, 9G, 9K, 9M, 9S, 53E/437T, 61Q, 64L, 64M, 72E/170A, 72E/405S, 94R, 96C, 96K, 98E, 98S, 98T, 113D, 113G, 113P, 118C, 118T/120V, 118V, 120V, 129P, 134E/158N, 158T, 165L, 170A, 170G, 170H, 170P, 170V, 171A, 171L, 171P, 171Q, 173I, 173K, 173L, 173S, 183I, 183L, 183P, 193F, 214K, 214R, 214R/222H, 222A, 222N, 222Q, 222R, 226S, 229M, 229Q, 234N, 234S, 234T, 253D, 253E, 253N, 253P, 253T, 253V, 265H, 269L, 269M, 269N, 269R, 272S, 289D, 289G, 289N, 289R, 296Q, 300A, 300E, 302G, 304K, 304P, 322A, 322G, 322K, 322P, 322P/407I, 322S, 322T, 322V/407I, 330S, 390I, 390R, 395I/439V, 396T, 396V, 398S, 399P, 399Q, 399S, 403V, 405A, 405D, 405P, 405S, 405T, 408D, 408K, 408S, 411H, 411K, 411T, 412K, 423T, 428E, 428G, 428I, 428L, 428N, 428Q, 428R, 428S, 428T, 428V, 428Y, 434E, 434G, 435A, 435D, 435E, 435G, 435I, 435K, 435L, 435N, 435S, 435V, 435Y, 438E, 438R, 438S, 439A, 439E, 439G, 439H, 439M, 439R, 439W, 442F, 442T, 444A, 448K, 448Q, 449G, 449L, 449S, 452T, and 454V, wherein the positions are numbered with reference to SEQ ID NO: 6468. In some embodiments, the polypeptide sequence of the engineered glycosyltransferase comprises at least one mutation or mutation set at one or more positions selected from P2F, P2H, P2K, P2M, P2Q, P2R, P2V, N3F, N3L, N3M, T4N, T4S, V9A, V9G, V9K, V9M, V9S, K53E/I437T, S61Q, F64L, F64M, D72E/D170A, D72E/E405S, K94R, G96C, G96K, D98E, D98S, D98T, S113D, S113G, S113P, A118C, A118T/L120V, A118V, L120V, A129P, D134E/P158N, P158T, Y165L, D170A, D170G, D170H, D170P, D170V, K171A, K171L, K171P, K171Q, R173I, R173K, R173L, R173S, M183I, M183L, M183P, Y193F, S214K, S214R, S214R/K222H, K222A, K222N, K222Q, K222R, E226S, L229M, L229Q, R234N, R234S, R234T, S253D, S253E, S253N, S253P, S253T, S253V, Q265H, Q269L, Q269M, Q269N, Q269R, P272S, K289D, K289G, K289N, K289R, R296Q, D300A, D300E, K302G, S304K, S304P, L322A, L322G, L322K, L322P, L322P/V407I, L322S, L322T, L322V/V407I, E330S, V390I, V390R, V395I/P439V, Y396T, Y396V, E398S, N399P, N399Q, N399S, R403V, E405A, E405D, E405P, E405S, E405T, N408D, N408K, N408S, R411H, R411K, R411T, R412K, R423T, K428E, K428G, K428I, K428L, K428N, K428Q, K428R, K428S, K428T, K428V, K428Y, D434E, D434G, R435A, R435D, R435E, R435G, R435I, R435K, R435L, R435N, R435S, R435V, R435Y, A438E, A438R, A438S, P439A, P439E, P439G, P439H, P439M, P439R, P439W, S442F, S442T, Y444A, E448K, E448Q, R449G, R449L, R449S, S452T, and I454V, wherein the positions are numbered with reference to SEQ ID NO: 6468. In some embodiments, the polypeptide sequence of the engineered glycosyltransferase comprises a sequence at least 90% identical to any of SEQ ID NOS: 6678, 6680, 6682, 6684, 6686, 6688, 6690, 6692, 6694, 6696, 6698, 6700, 6702, 6704, 6706, 6708, 6710, 6712, 6714, 6716, 6718, 6720, 6722, 6724, 6726, 6728, 6730, 6732, 6734, 6736, 6738, 6740, 6742, 6744, 6746, 6748, 6750, 6752, 6754, 6756, 6758, 6760, 6762, 6764, 6766, 6768, 6770, 6772, 6774, 6776, 6778, 6780, 6782, 6784, 6786, 6788, 6790, 6792, 6794, 6796, 6798, 6800, 6802, 6804, 6806, 6808, 6810, 6812, 6814, 6816, 6818, 6820, 6822, 6824, 6826, 6828, 6830, 6832, 6834, 6836, 6838, 6840, 6842, 6844, 6846, 6848, 6850, 6852, 6854, 6856, 6858, 6860, 6862, 6864, 6866, 6868, 6870, 6872, 6874, 6876, 6878, 6880, 6882, 6884, 6886, 6888, 6890, 6892, 6894, 6896, 6898, 6900, 6902, 6904, 6906, 6908, 6910, 6912, 6914, 6916, 6918, 6920, 6922, 6924, 6926, 6928, 6930, 6932, 6934, 6936, 6938, 6940, 6942, 6944, 6946, 6948, 6950, 6952, 6954, 6956, 6958, 6960, 6962, 6964, 6966, 6968, 6970, 6972, 6974, 6976, 6978, 6980, 6982, 6984, 6986, 6988, 6990, 6992, 6994, 6996, 6998, 7000, 7002, 7004, 7006, 7008, 7010, 7012, 7014, 7016, 7018, 7020, 7022, 7024, 7026, 7028, 7030, 7032, 7034, 7036, 7038, 7040, 7042, 7044, 7046, 7048, 7050, 7052, 7054, 7056, 7058, 7060, 7062, 7064, 7066, 7068, 7070, 7072, 7074, 7076, 7078, 7080, 7082, 7084, 7086, 7088, 7090, 7092, 7094, 7096, 7098, 7100, 7102, 7104, 7106, 7108, 7110, 7112, 7114, 7116, 7118, 7120, 7122, 7124, 7126, 7128, 7130, 7132, 7134, 7136, 7138, 7140, 7142, 7144, 7146, 7148, 7150, 7152, 7154, 7156, 7158, 7160, 7162, 7164, 7166, 7168, 7170, 7172, 7174, 7176, 7178, 7180, 7182, 7184, 7186, 7188, 7190, 7192, 7194, 7196, 7198, 7200, 7202, 7204, 7206, 7208, 7210, 7212, and 7214. In some embodiments, the polypeptide sequence of the engineered glycosyltransferase comprises a sequence at least 95% identical to any of SEQ ID NOS: 6678, 6680, 6682, 6684, 6686, 6688, 6690, 6692, 6694, 6696, 6698, 6700, 6702, 6704, 6706, 6708, 6710, 6712, 6714, 6716, 6718, 6720, 6722, 6724, 6726, 6728, 6730, 6732, 6734, 6736, 6738, 6740, 6742, 6744, 6746, 6748, 6750, 6752, 6754, 6756, 6758, 6760, 6762, 6764, 6766, 6768, 6770, 6772, 6774, 6776, 6778, 6780, 6782, 6784, 6786, 6788, 6790, 6792, 6794, 6796, 6798, 6800, 6802, 6804, 6806, 6808, 6810, 6812, 6814, 6816, 6818, 6820, 6822, 6824, 6826, 6828, 6830, 6832, 6834, 6836, 6838, 6840, 6842, 6844, 6846, 6848, 6850, 6852, 6854, 6856, 6858, 6860, 6862, 6864, 6866, 6868, 6870, 6872, 6874, 6876, 6878, 6880, 6882, 6884, 6886, 6888, 6890, 6892, 6894, 6896, 6898, 6900, 6902, 6904, 6906, 6908, 6910, 6912, 6914, 6916, 6918, 6920, 6922, 6924, 6926, 6928, 6930, 6932, 6934, 6936, 6938, 6940, 6942, 6944, 6946, 6948, 6950, 6952, 6954, 6956, 6958, 6960, 6962, 6964, 6966, 6968, 6970, 6972, 6974, 6976, 6978, 6980, 6982, 6984, 6986, 6988, 6990, 6992, 6994, 6996, 6998, 7000, 7002, 7004, 7006, 7008, 7010, 7012, 7014, 7016, 7018, 7020, 7022, 7024, 7026, 7028, 7030, 7032, 7034, 7036, 7038, 7040, 7042, 7044, 7046, 7048, 7050, 7052, 7054, 7056, 7058, 7060, 7062, 7064, 7066, 7068, 7070, 7072, 7074, 7076, 7078, 7080, 7082, 7084, 7086, 7088, 7090, 7092, 7094, 7096, 7098, 7100, 7102, 7104, 7106, 7108, 7110, 7112, 7114, 7116, 7118, 7120, 7122, 7124, 7126, 7128, 7130, 7132, 7134, 7136, 7138, 7140, 7142, 7144, 7146, 7148, 7150, 7152, 7154, 7156, 7158, 7160, 7162, 7164, 7166, 7168, 7170, 7172, 7174, 7176, 7178, 7180, 7182, 7184, 7186, 7188, 7190, 7192, 7194, 7196, 7198, 7200, 7202, 7204, 7206, 7208, 7210, 7212, and 7214. In some embodiments, the polypeptide sequence of the engineered glycosyltransferase comprises any of SEQ ID NOS: 6678, 6680, 6682, 6684, 6686, 6688, 6690, 6692, 6694, 6696, 6698, 6700, 6702, 6704, 6706, 6708, 6710, 6712, 6714, 6716, 6718, 6720, 6722, 6724, 6726, 6728, 6730, 6732, 6734, 6736, 6738, 6740, 6742, 6744, 6746, 6748, 6750, 6752, 6754, 6756, 6758, 6760, 6762, 6764, 6766, 6768, 6770, 6772, 6774, 6776, 6778, 6780, 6782, 6784, 6786, 6788, 6790, 6792, 6794, 6796, 6798, 6800, 6802, 6804, 6806, 6808, 6810, 6812, 6814, 6816, 6818, 6820, 6822, 6824, 6826, 6828, 6830, 6832, 6834, 6836, 6838, 6840, 6842, 6844, 6846, 6848, 6850, 6852, 6854, 6856, 6858, 6860, 6862, 6864, 6866, 6868, 6870, 6872, 6874, 6876, 6878, 6880, 6882, 6884, 6886, 6888, 6890, 6892, 6894, 6896, 6898, 6900, 6902, 6904, 6906, 6908, 6910, 6912, 6914, 6916, 6918, 6920, 6922, 6924, 6926, 6928, 6930, 6932, 6934, 6936, 6938, 6940, 6942, 6944, 6946, 6948, 6950, 6952, 6954, 6956, 6958, 6960, 6962, 6964, 6966, 6968, 6970, 6972, 6974, 6976, 6978, 6980, 6982, 6984, 6986, 6988, 6990, 6992, 6994, 6996, 6998, 7000, 7002, 7004, 7006, 7008, 7010, 7012, 7014, 7016, 7018, 7020, 7022, 7024, 7026, 7028, 7030, 7032, 7034, 7036, 7038, 7040, 7042, 7044, 7046, 7048, 7050, 7052, 7054, 7056, 7058, 7060, 7062, 7064, 7066, 7068, 7070, 7072, 7074, 7076, 7078, 7080, 7082, 7084, 7086, 7088, 7090, 7092, 7094, 7096, 7098, 7100, 7102, 7104, 7106, 7108, 7110, 7112, 7114, 7116, 7118, 7120, 7122, 7124, 7126, 7128, 7130, 7132, 7134, 7136, 7138, 7140, 7142, 7144, 7146, 7148, 7150, 7152, 7154, 7156, 7158, 7160, 7162, 7164, 7166, 7168, 7170, 7172, 7174, 7176, 7178, 7180, 7182, 7184, 7186, 7188, 7190, 7192, 7194, 7196, 7198, 7200, 7202, 7204, 7206, 7208, 7210, 7212, and 7214.

The present invention also provides engineered glycosyltransferases, wherein the polypeptide sequences of the engineered glycosyltransferases comprise at least one mutation or mutation set at one or more positions selected from 5/6/25/317, 5/6/69/288/303, 5/6/91/288/317, 5/25/91/212/303/317, 5/25/91/263, 5/25/288, 5/69/91/212/288, 5/69/91/212/303, 5/91/288/303, 5/91/303, 5/91/317/421, 5/288, 6/91/212/288/303/369/421, 6/212/288/303, 6/288, 25/91/212/288, 25/91/263/288/303, 25/91/303/317/369, 25/91/317/369, 25/263/317, 87/144, 87/144/159/361, 87/144/159/361/433, 87/433, 88/144, 88/144/159, 91/263/317/369, 91/288/303/317/369, 91/288/317/369/421, 91/303, 91/317, 91/317/369, 109/144/153/155/159/433, 144, 212/288, 263/288/303/317, and 288, wherein the positions are numbered with reference to SEQ ID NO: 6864. In some embodiments, the polypeptide sequence of the engineered glycosyltransferase comprises at least one mutation or mutation set at one or more positions selected from 5S/6P/25I/317Y, 5S/6P/69A/288P/303V, 5S/6P/91Q/288P/317Y, 5S/25Q/91Q/212L/303V/317Y, 5S/25Q/91Q/263T, 5S/25Q/288P, 5S/69A/91Q/212L/288P, 5S/69A/91Q/212L/303V, 5S/91Q/288P/303V, 5S/91Q/303V, 5S/91Q/317Y/421I, 5S/288P, 6P/91Q/212L/288P/303V/369K/421I, 6P/212L/288P/303V, 6P/288P, 25Q/91Q/212L/288P, 25Q/91Q/263T/288P/303V, 25Q/91Q/317Y/369K, 25Q/91T/303V/317Y/369K, 25Q/263T/317Y, 87K/144Q, 87K/144Q/159K/361C, 87K/144Q/159K/361C/433A, 87K/433A, 88T/144Q, 88T/144Q/159K, 91Q/263T/317Y/369K, 91Q/288P/303V/317Y/369K, 91Q/288P/317Y/369K/421I, 91Q/303V, 91Q/317Y, 91Q/317Y/369K, 109W/144Q/153V/155L/159K/433A, 144Q, 212L/288P, 263T/288P/303V/317Y, and 288P, wherein the positions are numbered with reference to SEQ ID NO: 6864. In some embodiments, the polypeptide sequence of the engineered glycosyltransferase comprises at least one mutation or mutation set at one or more positions selected from T5S/E6P/L25I/S317Y, T5S/E6P/D69A/E288P/Q303V, T5S/E6P/I91Q/E288P/S317Y, T5S/L25Q/I91Q/A212L/Q303V/S317Y, T5S/L25Q/I91Q/V263T, T5S/L25Q/E288P, T5S/D69A/I91Q/A212L/E288P, T5S/D69A/I91Q/A212L/Q303V, T5S/I91Q/E288P/Q303V, T5S/I91Q/Q303V, T5S/I91Q/S317Y/V421I, T5S/E288P, E6P/I91Q/A212L/E288P/Q303V/369K/V421I, E6P/A212L/E288P/Q303V, E6P/E288P, L25Q/I91Q/A212L/E288P, L25Q/I91Q/V263T/E288P/Q303V, L25Q/I91Q/S317Y/V369K, L25Q/I91T/Q303V/S317Y/V369K, L25Q/V263T/S317Y, M87K/M144Q, M87K/M144Q/Q159K/T361C, M87K/M144Q/ Q159K/T361C/L433A, M87K/L433A, R88T/M144Q, R88T/M144Q/Q159K, I91Q/V263T/S317Y/V369K, I91Q/E288P/Q303V/S317Y/V369K, I91Q/E288P/S317Y/V369K/V421I, I91Q/Q303V, I91Q/S317Y, I91Q/S317Y/V369K, R109W/M144Q/A153V/V155L/Q159K/L433A, M144Q, A212L/E288P, V263T/E288P/Q303V/S317Y, and E288P, wherein the positions are numbered with reference to SEQ ID NO: 6864. In some embodiments, the polypeptide sequence of the engineered glycosyltransferase comprises a sequence at least 90% identical to any of SEQ ID NOS: 7362, 7364, 7366, 7368, 7370, 7372, 7374, 7376, 7378, 7380, 7382, 7384, 7386, 7388, 7390, 7392, 7394, 7396, 7398, 7400, 7402, 7404, 7406, 7408, 7410, 7412, 7414, 7416, 7418, 7420, 7422, 7424, 7426, 7428, 7430, 7432, 7434, and 7436, wherein the positions are numbered with reference to SEQ ID NO: 6864. In some embodiments, the polypeptide sequence of the engineered glycosyltransferase comprises a sequence at least 95% identical to any of SEQ ID NOS: 7362, 7364, 7366, 7368, 7370, 7372, 7374, 7376, 7378, 7380, 7382, 7384, 7386, 7388, 7390, 7392, 7394, 7396, 7398, 7400, 7402, 7404, 7406, 7408, 7410, 7412, 7414, 7416, 7418, 7420, 7422, 7424, 7426, 7428, 7430, 7432, 7434, and 7436. In some embodiments, the polypeptide sequence of the engineered glycosyltransferase comprises any of SEQ ID NOS: 7362, 7364, 7366, 7368, 7370, 7372, 7374, 7376, 7378, 7380, 7382, 7384, 7386, 7388, 7390, 7392, 7394, 7396, 7398, 7400, 7402, 7404, 7406, 7408, 7410, 7412, 7414, 7416, 7418, 7420, 7422, 7424, 7426, 7428, 7430, 7432, 7434, and 7436.

The present invention also provides engineered glycosyltransferases, wherein the polypeptide sequences of the engineered glycosyltransferases comprise at least one mutation or mutation set at one or more positions selected from 2/3/433/435/442, 2/81, 9/37/113/396, 9/87, 9/144/331, 37/113/144/396, 37/233, 53/144/233/269/331/428, 53/233/269/390/395/396, 53/234, 61/120/156/163/165/197/303/308, 61/120/159/300/308/407, 61/120/300/303/407, 61/156/159/163/165/243/248/253/300/303/308, 61/156/163/243/248/300/303/308/407, 61/156/163/300/365/411, 61/156/197/253, 61/163/300/303/308/405/407/411, 61/165/248/253/407/411, 61/214, 61/214/300/308, 61/243/300/308/407/411, 61/300/303/308, 61/300/303/405, 61/365/405, 69, 69/81, 69/134, 69/263, 69/263/434/438/439, 69/439, 81, 81/134, 81/222, 81/222/263/322/435/442, 81/433/435/438/442, 85/156/159/243/248/253/308/405/407/411, 87/144, 87/144/396, 113/233/234, 120/156/159/169/197/214/303/308/365/405/407, 120/156/159/248/300/308, 120/156/248/303/308/411, 120/159, 120/159/165/197, 120/159/197/308/407/411, 120/159/197/365/411, 120/197/253/300/308, 120/253/300/303/308/407, 120/308/407/411, 134/222/263, 144/234/269, 156/165/248/300/303/308, 156/197/248/300/411, 156/214/308/411, 156/248/253/308, 159/163/165/197/214/243/300/303/308/407, 163/197/253/300/303/308/365, 171/263, 183/233/234/331/428, 197/253/308/407, 197/300/303/308/365, 197/300/308/411, 222, 222/263/435/442, 233/396/399, 263, 269, 269/428/437, 300/303/308, 300/308/405/411, 308, and 322, wherein the positions are numbered with reference to SEQ ID NO: 7388. In some embodiments, the polypeptide sequence of the engineered glycosyltransferase comprises at least one mutation or mutation set at one or more positions selected from 2K/3M/433A/435E/442F, 2K/81T, 9G/37S/113D/396T, 9G/87K, 9G/144Q/331R, 37S/113D/144Q/396T, 37S/2335, 53E/144Q/233Q/269R/331R/428I, 53E/233Q/269R/390I/395I/396T, 53E/234N, 61Q/120V/156S/163A/165L/197K/303V/308L, 61Q/120V/159K/300A/308L/407I, 61Q/120V/300A/303V/407I, 61Q/156S/159K/163A/165L/243I/248W/253T/300A/303V/

308L, 61Q/156S/163A/243I/248W/300A/303V/308L/407I, 61Q/156S/163A/300A/365I/411T, 61Q/156S/197K/253E, 61Q/163A/300A/303V/308L/405P/407I/411T, 61Q/165L/248W/253T/407I/411T, 61Q/214R, 61Q/214R/300A/308L, 61Q/243I/300A/308L/407I/411T, 61Q/300A/303V/308L, 61Q/300A/303V/405P, 61Q/365I/405P, 69A, 69A/81T, 69A/134E, 69A/263T, 69A/263T/434E/438S/439H, 69A/439H, 81T, 81T/134E, 81T/222A, 81T/222A/263T/322S/435E/442F, 81T/433A/435I/438R/442F, 85V/156S/159K/243I/248W/253T/308L/405P/407I/411T, 87K/144Q, 87K/144Q/396T, 113D/233Q/234N, 120V/156/159K/169D/197K/214R/303V/308L/365I/405P/407I, 120V/156S/159K/248W/300A/308L, 120V/156S/248W/303V/308L/411T, 120V/159K, 120V/159K/165L/197K, 120V/159K/197K/308L/407I/411T, 120V/159K/197K/365I/411T, 120V/197K/253T/300A/308L, 120V/253T/300A/303V/308L/407I, 120V/308L/407I/411T, 134E/222A/263T, 144Q/234N/269R, 156S/165L/248W/300A/303V/308L, 156S/197K/248W/300A/411T, 156S/214R/308L/411T, 156S/248W/253T/308L, 159K/163A/165L/197K/214R/243I/300A/303V/308L/407I, 163A/197K/253E/300A/303V/308L/365I, 171P/263T, 183L/233Q/234N/331R/428I, 197K/253T/308L/407I, 197K/300A/303V/308L/365I, 197K/300A/308L/411T, 222A, 222A/263T/435I/442F, 233Q/396T/399Q, 263T, 269R, 269R/428I/437L, 300A/303V/308L, 300A/308L/405P/411T, 308L, and 322S, wherein the positions are numbered with reference to SEQ ID NO: 7388. In some embodiments, the polypeptide sequence of the engineered glycosyltransferase comprises at least one mutation or mutation set at one or more positions selected from P2K/N3M/L433A/R435E/S442F, P2K/H81T, V9G/R37S/S113D/Y396T, V9G/M87K, V9G/M144Q/K331R, R37S/S113D/M144Q/Y396T, R37S/W233S, K53E/M144Q/W233Q/Q269R/K331R/K428I, K53E/W233Q/Q269R/V390I/V395I/Y396T, K53E/R234N, S61Q/L120V/C156S/L163A/Y165L/Q197K/Q303V/R308L, S61Q/L120V/Q159K/D300A/R308L/V407I, S61Q/L120V/D300A/Q303V/V407I, S61Q/C156S/Q159K/L163A/Y165L/L243I/H248W/S253T/D300A/Q303V/R308L, S61Q/C156S/L163A/L243I/H248W/D300A/Q303V/R308L/V407I, S61Q/C156S/L163A/D300A/V365I/R411T, S61Q/C156S/Q197K/S253E, S61Q/L163A/D300A/Q303V/R308L/E405P/V407I/R411T, S61Q/Y165L/H248W/S253T/V407I/R411T, S61Q/S214R, S61Q/S214R/D300A/R308L, S61Q/L243I/D300A/R308L/V407I/R411T, S61Q/D300A/Q303V/R308L, S61Q/D300A/Q303V/E405P, S61Q/V365I/E405P, D69A, D69A/H81T, D69A/D134E, D69A/V263T, D69A/V263T/D434E/A438S/P439H, D69A/P439H, H81T, H81T/D134E, H81T/K222A, H81T/K222A/V263T/L322S/R435E/S442F, H81T/L433A/R435I/A438R/S442F, A85V/C156S/Q159K/L243I/H248W/S253T/R308L/E405P/V407I/R411T, M87K/M144Q, M87K/M144Q/Y396T, S113D/W233Q/R234N, L120V/C156S/Q159K/E169D/Q197K/S214R/Q303V/R308L/V365I/E405P/V407I, L120V/C156S/Q159K/H248W/D300A/R308L, L120V/C156S/H248W/Q303V/R308L/R411T, L120V/Q159K, L120V/Q59K/Y165L/Q197K, L120V/Q59K/Q197K/R308L/V407I/R411T, L120V/Q159K/Q197K/V365I/R411T, L120V/Q197K/S253T/D300A/R308L, L120V/S253T/D300A/Q303V/R308L/V407I, L120V/R308L/V407I/R411T, D134E/K222A/V263T, M144Q/R234N/Q269R, C156S/Y165L/H248W/D300A/Q303V/R308L, C156S/Q197K/H248W/D300A/R411T, C156S/S214R/R308L/R411T, C156S/H248W/S253T/R308L, Q159K/L163A/Y165L/Q197K/S214R/L243I/D300A/Q303V/R308L/V407I, L163A/Q197K/S253E/D300A/Q303V/R308L/V365I, K171P/V263T, M183L/W233Q/R234N/K331R/K428I, Q197K/S253T/R308L/V407I, Q197K/D300A/Q303V/R308L/V365I, Q197K/D300A/R308L/R411T, K222A, K222A/V263T/R435I/S442F, W233Q/Y396T/N399Q, V263T, Q269R, Q269R/K428I/1437L, D300A/Q303V/R308L, D300A/R308L/E405P/R411T, R308L, and L322S, wherein the positions are numbered with reference to SEQ ID NO: 7388. In some embodiments, the polypeptide sequence of the engineered glycosyltransferase comprises at least one mutation or mutation set at one or more positions selected from 41, 56, 61, 72, 76, 87, 88, 107, 139, 156, 338, and 407, wherein the positions are numbered with reference to SEQ ID NO: 7388. In some embodiments, the polypeptide sequence of the engineered glycosyltransferase comprises at least one mutation or mutation set at one or more positions selected from 41E, 56D, 61D, 61E, 72P, 76S, 87E, 88L, 88M, 107L, 107V, 139N, 156S, 338V, and 407T, wherein the positions are numbered with reference to SEQ ID NO: 7388. In some embodiments, the polypeptide sequence of the engineered glycosyltransferase comprises at least one mutation or mutation set at one or more positions selected from A41E, L56D, S61D, S61E, T72P, R76S, M87E, R88L, R88M, A107L, A107V, K139N, C156S, C338V, and V407T, wherein the positions are numbered with reference to SEQ ID NO: 7388. In some embodiments, the polypeptide sequence of the engineered glycosyltransferase comprises a sequence at least 90% identical to any of SEQ ID NOS: 7946, 7948, 7950, 7952, 7954, 7956, 7958, 7960, 7962, 7964, 7966, 7968, 7970, 7972, 7974, 7976, 7978, 7980, 7982, 7984, 7986, 7988, 7990, 7992, 7994, 7996, 7998, 8000, 8002, 8004, 8006, 8008, 8010, 8012, 8014, 8016, 8018, 8020, 8022, 8024, 8026, 8028, 8030, 8032, 8034, 8036, 8038, 8040, 8042, 8044, 8046, 8048, 8050, 8052, 8054, 8056, 8058, 8060, 8062, 8064, 8066, 8068, 8070, 8072, 8074, 8076, 8078, 8080, 8082, 8084, 8086, 8088, 8090, 8340, 8342, 8344, 8346, 8348, 8350, 8352, 8354, 8356, 8358, 8360, 8362, 8364, 8366, and 8368. In some embodiments, the polypeptide sequence of the engineered glycosyltransferase comprises a sequence at least 95% identical to any of SEQ ID NOS: 7946, 7948, 7950, 7952, 7954, 7956, 7958, 7960, 7962, 7964, 7966, 7968, 7970, 7972, 7974, 7976, 7978, 7980, 7982, 7984, 7986, 7988, 7990, 7992, 7994, 7996, 7998, 8000, 8002, 8004, 8006, 8008, 8010, 8012, 8014, 8016, 8018, 8020, 8022, 8024, 8026, 8028, 8030, 8032, 8034, 8036, 8038, 8040, 8042, 8044, 8046, 8048, 8050, 8052, 8054, 8056, 8058, 8060, 8062, 8064, 8066, 8068, 8070, 8072, 8074, 8076, 8078, 8080, 8082, 8084, 8086, 8088, 8090, 8340, 8342, 8344, 8346, 8348, 8350, 8352, 8354, 8356, 8358, 8360, 8362, 8364, 8366, and 8368. In some embodiments, the polypeptide sequence of the engineered glycosyltransferase comprises any of SEQ ID NOS: 7946, 7948, 7950, 7952, 7954, 7956, 7958, 7960, 7962, 7964, 7966, 7968, 7970, 7972, 7974, 7976, 7978, 7980, 7982, 7984, 7986, 7988, 7990, 7992, 7994, 7996, 7998, 8000, 8002, 8004, 8006, 8008, 8010, 8012, 8014, 8016, 8018, 8020, 8022, 8024, 8026, 8028, 8030, 8032, 8034, 8036, 8038, 8040, 8042, 8044, 8046, 8048, 8050, 8052, 8054, 8056, 8058, 8060, 8062, 8064, 8066, 8068, 8070, 8072, 8074, 8076, 8078, 8080, 8082, 8084, 8086, 8088, 8090, 8340, 8342, 8344, 8346, 8348, 8350, 8352, 8354, 8356, 8358, 8360, 8362, 8364, 8366, and 8368.

The present invention also provides engineered glycosyltransferases, wherein the polypeptide sequences of the engineered glycosyltransferases comprise at least one mutation or mutation set at one or more positions selected from 37/72/76/81, 37/72/76/107/156/331, 37/72/195/331, 53/81/195/197, 69/72/76/107, 72/76/107/156, 72/76/107/195/197, 72/269, 81/107/195, 87, 87/91, 87/91/94, 87/91/94/120, 87/91/94/233, 87/91/94/233/259, 87/91/94/263/389, 87/91/120/233, 87/91/120/233/411/431/435/437, 87/91/144/259, 87/91/163, 87/91/163/233, 87/91/163/233/263, 87/91/163/389, 87/91/233, 87/91/233/389, 87/91/259/263/389/428/431/435/437, 87/91/263/389, 87/91/322, 87/91/389, 87/94, 87/94/144/263/428/435, 87/94/263, 87/163/233, 87/233, 87/233/259, 87/233/322/389/411, 87/233/389, 87/259, 87/263, 87/428/431/435, 87/435, 91, 91/94, 91/94/120/233, 91/94/120/233/389/431/438, 91/94/233/259, 91/120, 91/120/233, 91/233, 91/233/259/389, 91/233/389, 94/233/411, 144/389, 163/233, 195/197, 197, 233, 233/259/263, 233/259/389, 233/438, 259, 263, 263/389, 322, 389, and 428/431/435, wherein the positions are numbered with reference to SEQ ID NO: 8088. In some embodiments, the polypeptide sequence of the engineered glycosyltransferase comprises at least one mutation or mutation set at one or more positions selected from 37S/72P/76S/81T, 37S/72P/76S/107L/156S/331R, 37S/72P/195Q/331R, 53E/81T/195Q/197K, 69A/72P/76S/107L, 72P/76S/107L/156S, 72P/76S/107L/195Q/197K, 72P/269R, 81T/107L/195Q, 87A, 87A/91L, 87A/91L/94C/233Q, 87A/91L/94C/233Q/259T, 87A/91L/120L/233Q, 87A/91L/120L/233Q/411T/431M/435E/437L, 87A/91L/163A, 87A/91L/233Q, 87A/91L/233Q/389L, 87A/91L/259T/263T/389L/428I/431M/435I/437L, 87A/91L/322S, 87A/94C, 87A/94C/263T, 87A/233Q, 87A/233Q/259T, 87A/233Q/322S/389L/411T, 87A/233Q/389L, 87A/259T, 87A/263T, 87A/428I/431M/435E, 87A/435E, 87K, 87K/91L, 87K/91L/94C, 87K/91L/94C/120L, 87K/91L/94C/233Q, 87K/91L/94C/263T/389L, 87K/91L/120L/233Q, 87K/91L/144Q/259T, 87K/91L/163A/233Q, 87K/91L/163A/233Q/263T, 87K/91L/163A/389L, 87K/91L/233Q, 87K/91L/263T/389L, 87K/91L/389L, 87K/94C/144Q/263T/428I/435E, 87K/163A/233Q, 91L, 91L/94C, 91L/94C/120L/233Q, 91L/94C/120L/233Q/389L/431M/438S, 91L/94C/233Q/259T, 91L/120L, 91L/120L/233Q, 91L/233Q, 91L/233Q/259T/389L, 91L/233Q/389L, 94C/233Q/411T, 144Q/389L, 163A/233Q, 195Q/197K, 197K, 233Q, 233Q/259T/263T, 233Q/259T/389L, 233Q/438S, 259T, 263T, 263T/389L, 322S, 389L, and 428I/431M/435E, wherein the positions are numbered with reference to SEQ ID NO: 8088. In some embodiments, the polypeptide sequence of the engineered glycosyltransferase comprises at least one mutation or mutation set at one or more positions selected from R37S/T72P/R76S/H81T, R37S/T72P/R76S/A107L/C156S/K331R, R37S/T72P/H195Q/K331R, K53E/H81T/H195Q/Q197K, D69A/T72P/R76S/A107L, T72P/R76S/A107L/C156S, T72P/R76S/A107L/H195Q/Q197K, T72P/Q269R, H81T/A107L/H195Q, M87A, M87A/Q91L, M87A/Q91L/K94C/W233Q, M87A/Q91L/K94C/W233Q/E259T, M87A/Q91L/V120L/W233Q, M87A/Q91L/V120L/W233Q/R411T/D431M/R435E/I437L, M87A/Q91L/L163A, M87A/Q91L/W233Q, M87A/Q91L/W233Q/E389L, M87A/Q91L/E259T/V263T/E389L/K428I/D431M/R435I/I437L, M87A/Q91L/L322S, M87A/K94C, M87A/K94C/V263T, M87A/W233Q, M87A/W233Q/E259T, M87A/W233Q/L322S/E389L/R411T, M87A/W233Q/E389L, M87A/E259T, M87A/V263T, M87A/K428I/D431M/R435E, M87A/R435E, M87K, M87K/Q91L, M87K/Q91L/K94C, M87K/Q91L/K94C/V120L, M87K/Q91L/K94C/W233Q, M87K/Q91L/K94C/V263T/E389L, M87K/Q91L/V120L/W233Q, M87K/Q91L/M144Q/E259T, M87K/Q91L/L163A/W233Q, M87K/Q91L/L163A/W233Q/V263T, M87K/Q91L/L163A/E389L, M87K/Q91L/W233Q, M87K/Q91L/V263T/E389L, M87K/Q91L/E389L, M87K/K94C/M144Q/V263T/K428I/R435E, M87K/L163A/W233Q, Q91L, Q91L/K94C, Q91L/K94C/V120L/W233Q, Q91L/K94C/V120L/W233Q/E389L/D431M/A438S, Q91L/K94C/W233Q/E259T, Q91L/V120L, Q91L/V120L/W233Q, Q91L/W233Q, Q91L/W233Q/E389L, Q91L/W233Q/E259T/E389L, Q91L/W233Q/E389L, K94C/W233Q/R411T, M144Q/E389L, L163A/W233Q, H195Q/Q197K, Q197K, W233Q, W233Q/E259T/V263T, W233Q/E259T/E389L, W233Q/A438S, E259T, V263T, V263T/E389L, L322S, E389L, and K428I/D431M/R435E, wherein the positions are numbered with reference to SEQ ID NO: 8088. In some embodiments, the polypeptide sequence of the engineered glycosyltransferase comprises at least one mutation or mutation set at one or more positions selected from 55, 111, 252, 255, 324, 328, 413, and 451, wherein the positions are numbered with reference to SEQ ID NO: 8088. In some embodiments, the polypeptide sequence of the engineered glycosyltransferase comprises at least one mutation or mutation set at one or more positions selected from 55G, 111T, 252P, 255T, 324D, 324G, 328T, 413L, and 451Q, wherein the positions are numbered with reference to SEQ ID NO: 8088. In some embodiments, the polypeptide sequence of the engineered glycosyltransferase comprises at least one mutation or mutation set at one or more positions selected from S55G, S111T, S252P, S255T, P324D, P324G, L328T, V413L, and V451Q, wherein the positions are numbered with reference to SEQ ID NO: 8088. In some embodiments, the polypeptide sequence of the engineered glycosyltransferase comprises a sequence at least 90% identical to any of SEQ ID NOS: 8482, 8484, 8486, 8488, 8490, 8492, 8494, 8496, 8498, 8500, 8502, 8504, 8506, 8508, 8510, 8512, 8514, 8516, 8518, 8520, 8522, 8524, 8526, 8528, 8530, 8532, 8534, 8536, 8538, 8540, 8542, 8544, 8546, 8548, 8550, 8552, 8554, 8556, 8558, 8560, 8562, 8564, 8566, 8568, 8570, 8572, 8574, 8576, 8578, 8580, 8582, 8584, 8586, 8588, 8590, 8592, 8594, 8596, 8598, 8600, 8602, 8604, 8606, 8608, 8610, 8612, 8614, 8616, 8618, 8620, 8622, 9224, 9226, 9228, 9230, 9232, 9234, 9236, 9238, and 9240. In some embodiments, the polypeptide sequence of the engineered glycosyltransferase comprises a sequence at least 95% identical to any of SEQ ID NOS: 8482, 8484, 8486, 8488, 8490, 8492, 8494, 8496, 8498, 8500, 8502, 8504, 8506, 8508, 8510, 8512, 8514, 8516, 8518, 8520, 8522, 8524, 8526, 8528, 8530, 8532, 8534, 8536, 8538, 8540, 8542, 8544, 8546, 8548, 8550, 8552, 8554, 8556, 8558, 8560, 8562, 8564, 8566, 8568, 8570, 8572, 8574, 8576, 8578, 8580, 8582, 8584, 8586, 8588, 8590, 8592, 8594, 8596, 8598, 8600, 8602, 8604, 8606, 8608, 8610, 8612, 8614, 8616, 8618, 8620, 8622, 9224, 9226, 9228, 9230, 9232, 9234, 9236, 9238, and 9240. In some embodiments, the polypeptide sequence of the engineered glycosyltransferase comprises any of SEQ ID NOS: 8482, 8484, 8486, 8488, 8490, 8492, 8494, 8496, 8498, 8500, 8502, 8504, 8506, 8508, 8510, 8512, 8514, 8516, 8518, 8520, 8522, 8524, 8526, 8528, 8530, 8532, 8534, 8536, 8538, 8540, 8542, 8544, 8546, 8548, 8550, 8552, 8554, 8556, 8558, 8560, 8562, 8564, 8566, 8568, 8570, 8572, 8574, 8576, 8578, 8580, 8582, 8584, 8586, 8588, 8590, 8592, 8594, 8596, 8598, 8600, 8602, 8604, 8606, 8608, 8610, 8612, 8614, 8616, 8618, 8620, 8622, 9224, 9226, 9228, 9230, 9232, 9234, 9236, 9238, and 9240.

In some embodiments, the polypeptide sequence of the engineered glycosyltransferase comprises a sequence at least 90% identical to any of SEQ ID NOS:76, 78, 80, 82, 84, 86, 88, 90, 92, 94, 96, 98, 100, 102, 104, 106, and/or 108. In some embodiments, the polypeptide sequence of the engineered glycosyltransferase comprises a sequence at least 95% identical to any of SEQ ID NOS: 76, 78, 80, 82, 84, 86, 88, 90, 92, 94, 96, 98, 100, 102, 104, 106, and/or 108.

In some embodiments, the polypeptide sequence of the engineered glycosyltransferase comprises SEQ ID NOS: 76, 78, 80, 82, 84, 86, 88, 90, 92, 94, 96, 98, 100, 102, 104, 106, and/or 108.

The present invention also provides engineered glycosyltransferases, wherein the polypeptide sequences of the engineered glycosyltransferases comprise at least one mutation or mutation set at one or more positions selected from 69/173/175/243/246/354/365/383/399, 69/173/243/383/399, 56/191/354/383/399, 70/225/246/409/413, 70/115/225/409, 70/225/413, 70/225/247, 74/310/396/424, 74/396, and 173/175/191/365/383/399, wherein the positions are numbered with reference to SEQ ID NO:758. In some embodiments, the polypeptide sequence of the engineered glycosyltransferase comprises at least one mutation or mutation set at one or more positions selected from 69H/173N/175S/243A/246K/354I/365I/383V/399A, 69H/173N/243A/383V/399A, 56T/191D/354I/383V/399A, 70L/225G/246P/409K/413V, 70L/115S/225G/409K, 70L/225G/413V, 70L/225G/247G, 74T/310D/396E/4245, 74T/396E, and 173H/175S/191D/365I/383V/399A, wherein the positions are numbered with reference to SEQ ID NO:758. In some embodiments, the polypeptide sequence of the engineered glycosyltransferase comprises at least one mutation or mutation set at one or more positions selected from R69H/Y173N/P175S/V243A/M246K/L354I/M365I/M383V/T399A, R69H/Y173N/V243A/M383V/T399A, I56T/N191D/L354I/M383V/T399A, F70L/N225G/M246P/E409K/I413V, F70L/Q115S/N225G/E409K, F70L/N225G/I413V, F70L/N225G/E247G, H74T/K310D/G396E/N424S, H74T/G396E, and Y173H/P175S/N191D/M365I/M383V/T399A, wherein the positions are numbered with reference to SEQ ID NO:758. In some embodiments, the polypeptide sequence of the engineered glycosyltransferase comprises a sequence at least 90% identical to any of SEQ ID NOS: 770, 772, 774, 776, 778, 780, 782, 784, 786, and/or 788. In some embodiments, the polypeptide sequence of the engineered glycosyltransferase comprises a sequence at least 95% identical to any of SEQ ID NOS: 770, 772, 774, 776, 778, 780, 782, 784, 786, and/or 788. In some additional embodiments, the polypeptide sequence of the engineered glycosyltransferase comprises any of SEQ ID NOS: 770, 772, 774, 776, 778, 780, 782, 784, 786, and/or 788.

The present invention also provides engineered glycosyltransferases, wherein the polypeptide sequences of the engineered glycosyltransferases comprise at least one mutation or mutation set at one or more positions selected from 24/28, 24/28/262, 24/28/262/264, 24/28/262/264/423, 24/264/294, 28, 28/262/264, 28/423, 69/173/175/243/246/354/365/383/399, 69/173/243/383/399, 56/191/354/383/399, 70/115/225/409, 70/225/246/409/413, 70/225/247, 70/225/413, 74/310/396/424, 74/396, 159, 173/175/191/365/383/399, 199, 262/264, and 264/29, wherein the positions are numbered with reference to SEQ ID NO:770. In some embodiments, the polypeptide sequence of the engineered glycosyltransferase comprises at least one mutation or mutation set at one or more positions selected from 24E/28N, 24E/28N/262Y, 24E/28N/262Y/264S, 24E/28N/262Y/264S/423E, 24E/264S/294V, 28N, 28N/262Y/264S, 28N/423E, 69H/173N/175/243A/246K/354I/365I/383V/399A, 69H/173N/243A/383V/399A, 56T/191D/354I/383V/399A, 70L/1155/225G/409K, 70L/225G/246P/409K/413V, 70L/225G/247G, 70L/225G/413V, 74T/310D/396E/4245, 74T/396E, 159R, 173H/175S/191D/365I/383V/399A, 199H, 262Y/264S, and 264S/291V, wherein the positions are numbered with reference to SEQ ID NO:770. In some embodiments, the polypeptide sequence of the engineered glycosyltransferase comprises at least one mutation or mutation set at one or more positions selected from Y24E/S28N, Y24E/S28N/F262Y, Y24E/S28N/F262Y/C264S, Y24E/S28N/F262Y/C264S/K423E, Y24E/C264S/A294V, S28N, S28N/F262Y/C264S, S28N/K423E, R69H/Y173N/P175S/V243A/M246K/L354I/M365I/M383V/T399A, R69H/Y173N/V243A/M383V/T399A, I56T/N191D/L354I/M383V/T399A, F70L/Q115S/N225G/E409K, F70L/N225G/M246P/E409K/I413V, F70L/N225G/E247G, F70L/N225G/I413V, H74T/K310D/G396E/N424S, H74T/G396E, F156R, Y173H/P175S/N191D/M365I/M383V/T399A, G199H, F262Y/C264S, and C264S/I291V, wherein the positions are numbered with reference to SEQ ID NO:770. In some embodiments, the polypeptide sequence of the engineered glycosyltransferase comprises a sequence at least 90% identical to any of SEQ ID NOS: 790, 792, 794, 796, 798, 800, 802, 804, 806, 808, 1292, and/or 1294. In some embodiments, the polypeptide sequence of the engineered glycosyltransferase comprises a sequence at least 95% identical to any of SEQ ID NOS: 790, 792, 794, 796, 798, 800, 802, 804, 806, 808, 1292, and/or 1294. In some additional embodiments, the polypeptide sequence of the engineered glycosyltransferase comprises any of SEQ ID NOS: 790, 792, 794, 796, 798, 800, 802, 804, 806, 808, 1292, and/or 1294.

The present invention also provides engineered glycosyltransferases, wherein the polypeptide sequences of the engineered glycosyltransferases comprise at least one mutation or mutation set at one or more positions selected from 24, 28, 32, 264, 269, 325, 341, 351, and 366, wherein the positions are numbered with reference to SEQ ID NO:770. In some embodiments, the polypeptide sequence of the engineered glycosyltransferase comprises at least one mutation or mutation set at one or more positions selected from 24L/V, 28G/K/L, 32C/R/S, 264A/G, 269S/W, 325G/H, 341V, 351L, and 366L/Q/T, wherein the positions are numbered with reference to SEQ ID NO:770. In some embodiments, the polypeptide sequence of the engineered glycosyltransferase comprises at least one mutation or mutation set at one or more positions selected from Y24L/V, S28G/K/L, N32C/R/S, C264A/G, Y269S/W, K325G/H, F341V, M351L, and H366L/Q/T, wherein the positions are numbered with reference to SEQ ID NO:770. In some embodiments, the polypeptide sequence of the engineered glycosyltransferase comprises a sequence at least 90% identical to any of SEQ ID NOS: 810, 812, 814, 816, 818, 820, 822, 824, 826, 828, 830, 832, 834, 836, 838, 840, 842, 844, and/or 846.

In some embodiments, the polypeptide sequence of the engineered glycosyltransferase comprises a sequence at least 95% identical to any of SEQ ID NOS: 810, 812, 814, 816, 818, 820, 822, 824, 826, 828, 830, 832, 834, 836, 838, 840, 842, 844, and/or 846. In some embodiments, the polypeptide sequence of the engineered glycosyltransferase comprises any of SEQ ID NOS: 810, 812, 814, 816, 818, 820, 822, 824, 826, 828, 830, 832, 834, 836, 838, 840, 842, 844, and/or 846.

The present invention also provides engineered glycosyltransferases, wherein the polypeptide sequences of the engineered glycosyltransferases comprise at least one mutation or mutation set at one or more positions selected from 56/69/70/175/191/246, 56/69/70/175/191/246/354, 56/69/70/175/354, 56/69/70/191/246/354/365, 56/69/70/246/354, 56/69/175/191/246/354, 56/69/175/246/354, 56/69/175/246/354/365, 56/69/246/354, 56/69/246/365, 56/70/175/191/246, 56/70/175/191/246/354, 56/70/175/191/354/365, 56/70/175/246/354, 56/70/175/246/365, 56/70/191/246/354/365, 56/70/191/354, 56/175/246, 56/175/354, 56/175/354/365, 56/191/246/354, 56/246, 56/246/354/365, 56/354, 69, 69/70/175/191/246/354/365, 69/70/191/246/354/365, 69/70/246, 69/70/354/365, 69/175/191/246/354, 69/175/354, 69/246/354/365, 69/354, 70, 70/175/191/246/354/365, 70/175/191/354/365, 70/191/246/354/365, 70/191/246/365, 126, 126/220, 126/403, 175, 175/191, 175/191/246/354/365, 175/191/354, 175/191/354/365, 175/246/354, 175/246/354/365, 175/354, 191/246/354, 246/354, 354, and 354/365, wherein the positions are numbered with reference to SEQ ID NO:770. In some embodiments, the polypeptide sequence of the engineered glycosyltransferase comprises at least one mutation or mutation set at one or more positions selected from 56T/69Q/70L/175S/191D/246K, 56T/69Q/70L/175S/191D/246K/354I, 56T/69Q/70L/175S/354I, 56T/69Q/70L/191D/246K/354I/365I, 56T/69Q/70L/246K/354I, 56T/69Q/175S/191D/246K/354I, 56T/69Q/175S/246K/354I, 56T/69Q/175S/246K/354I/365I, 56T/69Q/246K/354I, 56T/69Q/246K/M65I, 56T/70L/175S/191D/246K, 56T/70L/175S/191D/246K/354I, 56T/70L/175S/191D/354I/365I, 56T/70L/175S/246K/354I, 56T/70L/175S/246K/365I, 56T/70L/191D/246K/354I/365I, 56T/70L/191D/354I, 56T/175S/246K, 56T/175S/354I, 56T/175S/354I/365I, 56T/191D/246K/354I, 56T/246K, 56T/246K/354I/365I, 56T/354I, 69Q, 69Q/70L/175S/191D/246K/354I/365I, 69Q/70L/191D/246K/354I/365I, 69Q/70L/246K, 69Q/70L/354I/365I, 69Q/175S/191D/246K/354I, 69Q/175S/354I, 69Q/246K/354I/365I, 69Q/354I, 70L, 70L/175S/191D/246K/354I/365I, 70L/175S/191D/354I/365I, 70L/191D/246K/354I/365I, 70L/191D/246K/365I, 126F, 126F/220L, 126F/403R, 175S, 175/191D, 175/191D/246K/354I/365I, 175S/191D/354I, 175S/191D/354I/365I, 175S/246K/354I, 175S/246K/354I/365I, 175S/354I, 191D/246K/354I, 246K/354I, 354I, and 354I/365I, wherein the positions are numbered with reference to SEQ ID NO:770. In some embodiments, the polypeptide sequence of the engineered glycosyltransferase comprises at least one mutation or mutation set at one or more positions selected from I56T/H69Q/F70L/P175S/N191D/M246K, I56T/H69Q/F70L/P175S/N191D/M246K/L354I, I56T/H69Q/F70L/P175S/L354I, I56T/H69Q/F70L/N191D/M246K/L354I/M365I, I56T/H69Q/F70L/M246K/L354I, I56T/H69Q/P175S/N191D/M246K/L354I, I56T/H69Q/P175S/M246K/L354I, I56T/H69Q/P175S/M246K/L354I/M365I, I56T/H69Q/M246K/L354I, I56T/H69Q/M246K/M365I, I56T/F70L/P175S/N191D/M246K, I56T/F70L/P175S/N191D/M246K/L354I, I56T/F70L/P175S/N191D/L354I/M365I, I56T/F70L/P175S/M246K/L354I, I56T/F70L/P175S/M246K/M365I, I56T/F70L/N191D/M246K/L354I/M365I, I56T/F70L/N191D/L354I, I56T/P175S/M246K, I56T/P175S/L354I, I56T/P175S/L354I/M365I, I56T/N191D/M246K/L354I, I56T/M246K, I56T/M246K/L354I/M365I, I56T/L354I, H69Q, H69Q/F70L/P175S/N191D/M246K/L354I/M365I, H69Q/F70L/N191D/M246K/L354I/M365I, H69Q/F70L/M246K, H69Q/F70L/L354I/M365I, H69Q/P175S/N191D/M246K/L354I, H69Q/P175S/L354I, H69Q/M246K/L354I/M365I, H69Q/L354I, F70L, F70L/P175S/N191D/M246K/L354I/M365I, F70L/P175S/N191D/L354I/M365I, F70L/N191D/M246K/L354I/M365I, F70L/N191D/M246K/M365I, I126F, I126F/C220L, I126F/K403R, P175S, P175S/N191D, P175S/N191D/M246K/L354I/M365I, P175S/N191D/L354I, P175S/N191D/L354I/M365I, P175S/M246K/L354I, P175S/M246K/L354I/M365I, P175S/L354I, N191D/M246K/L354I, M246K/L354I, L354I, and L354I/M365I, wherein the positions are numbered with reference to SEQ ID NO:770. In some additional embodiments, the polypeptide sequence of the engineered glycosyltransferase comprises a sequence at least 90% identical to any of SEQ ID NOS: 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, and/or 952. In some embodiments, the polypeptide sequence of the engineered glycosyltransferase comprises a sequence at least 95% identical to any of SEQ ID NOS: 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, and/or 952. In some embodiments, the polypeptide sequence of the engineered glycosyltransferase comprises any of SEQ ID NOS: 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, and/or 952.

The present invention also provides engineered glycosyltransferases, wherein the polypeptide sequences of the engineered glycosyltransferases comprise at least one mutation or mutation set at one or more positions selected from 24/32/264/269/330/402/403, 24/32/264/269/382/403/406, 24/32/264/269/330, 24/32/269, 24/32/269/382/385/389/402/406, 24/32/269/403, 24/32/330, 24/264/269/389/402/406, 70/126/175/191/246/325/354/366, 70/126/175/325/330/351/354/366, 70/126/191/246/325/351/354/366/423, 70/126/191/246/325/351/354/423, 70/126/191/246/325/351/366/423, 70/126/191/246/354/366, 70/126/246/330/366, 70/126/246/354/366, 126/211/220/253/316/342, 126/211/220/275/279/323, 126/211/260/423, 126/220/260, 126/220/316, 56/220/260/423, 220/260, and 220/260/423, wherein the positions are numbered with reference to SEQ ID NO:792. In some embodiments, the polypeptide sequence of the engineered glycosyltransferase comprises at least one mutation or mutation set at one or more positions selected from 24L/32S/264A/269S/330Q/402V/403R, 24L/32S/264A/269S/382G/403R/406M, 24L/32S/264A/330Q, 24L/32S/269S, 24L/32S/269S/382G/385V/389E/402I/406M, 24L/32S/269S/403R, 24L/32S/330Q, 24L/264A/269S/389E/402V/406M, 70L/126F/175S/191D/246K/325H/354I/366Q, 70L/126F/175S/325H/330Q/351L/354I/366Q, 70L/126F/191D/246K/325H/351L/354I/366Q/423K, 70L/126F/191D/246K/325H/351L/354I/423K, 70L/126F/191D/246K/325H/351L/366Q/423K, 70L/126F/191D/246K/325H/351/366Q/423K, 70L/126F/191D/246K/354I/366Q, 70L/126F/246K/330Q/366Q, 70L/126F/246K/354I/366Q, 126F/211E/220L/253D/316V/342L, 126F/211E/220L/275Q/279L/323V, 126F/211E/260V/423K, 126F/220L/260V, 126F/220L/316V, 56V/220L/260V/423K, 220L/260V, and 220L/260V/423K, wherein the positions are numbered with reference to SEQ ID NO:792. In some embodiments, the polypeptide sequence of the engineered glycosyltransferase comprises at least one mutation or mutation set at one or more positions selected from E24L/N32S/S264A/Y269S/P330Q/L402V/K403R, E24L/N32S/S264A/Y269S/A382G/K403R/I406M, E24L/N32S/S264A/P330Q, E24L/N32S/Y269S, E24L/N32S/Y269S/A382G/I385V/D389E/L402I/I406M, E24L/N32S/Y269S/K403R, E24L/N32S/P330Q, E24L/S264A/Y269S/D389E/L402V/I406M, F70L/I126F/P175S/N191D/M246K/K325H/L354I/H366Q, F70L/I126F/P175S/K325H/P330Q/M351L/L354I/H366Q, F70L/I126F/N191D/M246K/K325H/M351L/L354I/H366Q/E423K, F70L/I126F/N191D/M246K/K325H/M351L/L354I/E423K, F70L/I126F/N191D/M246K/K325H/M351L/H366Q/E423K, F70L/I126F/N191D/M246K/L354I/H366Q, F70L/I126F/M246K/P330Q/H366Q, F70L/I126F/M246K/L354I/

H366Q, I126F/T211E/C220L/G253D/I316V/I342L, I126F/ T211E/C220L/D275Q/V279L/L323V, I126F/T211E/ T260V/E423K, I126F/C220L/T260V, I126F/C220L/I316V, I56V/C220L/T260V/E423K, C220L/T260V, and C220L/ T260V/E423K, wherein the positions are numbered with reference to SEQ ID NO:792. In some embodiments, the polypeptide sequence of the engineered glycosyltransferase comprises a sequence at least 90% identical to any of SEQ ID NOS: 954, 956, 958, 960, 962, 964, 966, 968, 970, 972, 974, 976, 978, 980, 982, 984, 986, 988, 990, 992, 994, 996, 998, and/or 1000. In some embodiments, the polypeptide sequence of the engineered glycosyltransferase comprises a sequence at least 95% identical to any of SEQ ID NOS: 954, 956, 958, 960, 962, 964, 966, 968, 970, 972, 974, 976, 978, 980, 982, 984, 986, 988, 990, 992, 994, 996, 998, and/or 1000. In some embodiments, the polypeptide sequence of the engineered glycosyltransferase comprises any of SEQ ID NOS: 954, 956, 958, 960, 962, 964, 966, 968, 970, 972, 974, 976, 978, 980, 982, 984, 986, 988, 990, 992, 994, 996, 998, and/or 1000.

The present invention also provides engineered glycosyltransferases, wherein the polypeptide sequence of the engineered glycosyltransferases comprise at least one mutation or mutation set at one or more positions selected from 24/32/97/162/202, 24/32/126/198/201/367, 24/32/126/198/ 202/220/226/260/2695, 24/32/146/226, 24/32/198/201/220/ 226, 24/32/198/201/226, 24/97/260/367, 32/97/198/202/ 226/260, 32/202/367, 32/226/367, 56/175/197/211/330/382/ 385, 56/175/197/253/385/389, 56/175/264/382/385/389/ 402/406, 56/197/264/279/330/382/389/402/403/406, 56/211/253/316/323, 56/211/264/316/389, 56/211/279/323/ 330/402, 56/264/385/389, 97/202/367, 162/220/226/367, 175/197/211/264/330, 175/211/264/279/316/323, 175/211/ 279/323/330/402/403/406, 175/211/323/382/402/403/406, 175/211/403/406, 175/264/316/323/330/403/406, 175/264/ 316/389/402, 175/264/323/330, 197/211/316/342/406, 197/ 211/316/382/389/402/403, 197/211/402, 197/279/323, 198/ 201/367, 198/202/220/269/367, 201/202/367, 211/382/406, 211/385/389, 211/402/403, and 389, wherein the positions are numbered with reference to SEQ ID NO:954. In some embodiments, the polypeptide sequence of the engineered glycosyltransferase comprises at least one mutation or mutation set at one or more positions selected from 24L/32S/ 97G/162R/202G, 24L/32S/126A/198P/201G/367W, 24L/ 32S/126A/198P/202G/220L/226V/260V/269S, 24L/32S/ 146A/226V, 24L/32S/198P/201G/220L/226V, 24L/32S/ 198P/201G/226V, 24L/97G/260V/367W, 32S/97G/198P/ 202G/226V/260V, 32S/202G/367W, 32S/226V/367W, 56V/ 175S/197P/211E/330Q/382G/385V, 56V/175S/197P/253D/ 385V/389E, 56V/175S/264A/382G/385V/389E/402V/ 406M, 56V/197P/264A/279L/330Q/382G/389E/402V/ 403R/406M, 56V/211E/253D/316V/323V, 56V/211E/ 264A/316V/389E, 56V/211E/279L/323V/330Q/402I, 56V/ 264A/385V/389E, 97G/202G/367W, 162R/220L/226V/ 367W, 175S/197P/211E/264A/330Q, 1755/211E/264A/ 279L/316V/323V, 1755/211E/279L/323V/330Q/402I/ 403R/406M, 1755/211E/323V/382G/402I/403R/406M, 1755/211E/403R/406M, 175S/264A/316V/323V/330Q/ 403R/406M, 175S/264A/316V/389E/402V, 175S/264A/ 323V/330Q, 197P/211E/316V/342L/406M, 197P/211E/ 316V/382G/389E/402I/403R, 197P/211E/402I, 197P/279L/ 323V, 198P/201G/367W, 198P/202G/220L/269S/367W, 201G/202G/367W, 211E/382G/406M, 211E/385V/389E, 211E/402I/403R, and D389E, wherein the positions are numbered with reference to SEQ ID NO:954. In some embodiments, the polypeptide sequence of the engineered glycosyltransferase comprises at least one mutation or mutation set at one or more positions selected from E24L/N32S/ H97G/N162R/Q202G, E24L/N32S/F126A/E198P/M201G/ N367W, E24L/N32S/F126A/E198P/Q202G/C220L/ W226V/T260V/Y269S, E24L/N32S/L146A/W226V, E24L/ N32S/E198P/M201G/C220L/W226V, E24L/N32S/E198P/ M201G/W226V, E24L/H97G/T260V/N367W, N32S/ H97G/E198P/Q202G/W226V/T260V, N32S/Q202G/ N367W, N32S/W226V/N367W, I56V/P175S/A197P/ T211E/P330Q/A382G/I385V, I56V/P175S/A197P/G253D/ I385V/D389E, I56V/P175S/S264A/A382G/I385V/D389E/ L402V/I406M, I56V/A197P/S264A/V279L/P330Q/ A382G/D389E/L402V/K403R/I406M, I56V/T211E/ G253D/I316V/L323V, I56V/T211E/S264A/I316V/D389E, I56V/T211E/V279L/L323V/P330Q/L402I, I56V/S264A/ I385V/D389E, H97G/Q202G/N367W, N162R/C220L/ W226V/N367W, P175S/A197P/T211E/S264A/P330Q, P175S/T211E/S264A/V279L/I316V/L323V, P175S/T211E/ V279L/L323V/P330Q/L402I/K403R/I406M, P175S/ T211E/L323V/A382G/L402I/K403R/I406M, P175S/ T211E/K403R/I406M, P175S/S264A/I316V/L323V/ P330Q/K403R/I406M, P175S/S264A/I316V/D389E/ L402V, P175S/S264A/L323V/P330Q, A197P/T211E/ I316V/I342L/I406M, A197P/T211E/I316V/A382G/D389E/ L402I/K403R, A197P/T211E/L402I, A197P/V279L/L323V, E198P/M201G/N367W, E198P/Q202G/C220L/Y269S/ N367W, M201G/Q202G/N367W, T211E/A382G/I406M, T211E/I385V/D389E, T211E/L402I/K403R, and D389E, wherein the positions are numbered with reference to SEQ ID NO: 954. In some embodiments, the polypeptide sequence of the engineered glycosyltransferase comprises a sequence at least 90% identical to any of SEQ ID NOS: 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, and/or 1078. In some embodiments, the polypeptide sequence of the engineered glycosyltransferase comprises a sequence at least 95% identical to any of SEQ ID NOS: 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, and/or 1078. In some additional embodiments, the polypeptide sequence of the engineered glycosyltransferase comprises any of SEQ ID NOS: 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, and/or 1078.

The present invention also provides engineered glycosyltransferases, wherein the polypeptide sequence of the engineered glycosyltransferases comprise at least one mutation or mutation set at one or more positions selected from 24/32/175/211/260/330/403/406, 24/32/175/226/253/275/ 316, 24/32/201/226/260/264/330/402/406, 24/162/175/198/ 211/226/275/316/323/389, 24/162/175/201/275/316, 24/162/198/201/211/226/323/351, 24/162/198/201/226/351, 24/162/201/253/264/351/402/406, 24/175/198/211/226/ 253/316, 24/175/201/275/316/351, 24/175/201/316, 24/175/ 211/220/260/275/330/389, 24/175/211/253/316, 24/175/ 211/316/330, 24/175/226/323/351, 24/198/201, 24/198/201/ 211, 24/198/201/211/220/260, 24/198/201/220/275/389/ 402/406, 24/198/201/226/230/389, 24/198/201/351, 24/201/ 211/253/323/351/366/389/402/403, 24/201/226/253/402/ 403/406, 24/226/330/351/403, 175/198/201/211/226/260/ 264/323/402/406, and 175/198/226/260/351/402/403/406, wherein the positions are numbered with reference to SEQ ID NO: 1054. In some embodiments, the polypeptide sequence of the engineered glycosyltransferase comprises at least one mutation or mutation set at one or more positions selected from 24L/32S/175S/211E/260V/330Q/403R/406M, 24L/32S/175S/226V/253D/275Q/316V, 24L/32S/201G/226V/260V/264A/330Q/402I/406M, 24L/162R/175S/198P/211E/226V/275Q/316V/323V/389E, 24L/162R/175S/201G/275Q/316V, 24L/162R/198P/201G/211E/226V/323V/351M, 24L/162R/198P/201G/226V/351M, 24L/162R/201G/253D/264A/351M/402I/406M, 24L/175S/198P/211E/226V/253D/316V, 24L/175S/201G/275Q/316V/351M, 24L/175S/201G/316V, 24L/175S/211E/220L/260V/275Q/330Q/389E, 24L/175S/211E/253D/316V, 24L/175S/211E/316V/330Q, 24L/175S/226V/323V/351M, 24L/198P/201G, 24L/198P/201G/211E, 24L/198P/201G/211E/220L/260V, 24L/198P/201G/220L/275Q/389E/402I/406M, 24L/198P/201G/226V/330Q/389E, 24L/198P/201G/351M, 24L/201G/211E/253D/323V/351M/366H/389E/402I/403R, 24L/201G/226V/253D/402I/403R/406M, 24L/226V/330Q/351M/403R, 175S/198P/201G/211E/226V/260V/264A/323V/402I/406M, and 175S/198P/226V/260V/351M/402I/403R/406M, wherein the positions are numbered with reference to SEQ ID NO: 1054. In some embodiments, the polypeptide sequence of the engineered glycosyltransferase comprises at least one mutation or mutation set at one or more positions selected from E24L/N32S/P175S/T211E/T260V/P330Q/K403R/I406M, E24L/N32S/P175S/W226V/G253D/D275Q/I316V, E24L/N32S/M201G/W226V/T260V/S264A/P330Q/L402I/I406M, E24L/N162R/P175S/E198P/T211E/W226V/D275Q/I316V/L323V/D389E, E24L/N162R/P175S/M201G/D275Q/I316V, E24L/N162R/E198P/M201G/T211E/W226V/L323V/L351M, E24L/N162R/E198P/M201G/W226V/L351M, E24L/N162R/M201G/G253D/S264A/L351M/L402I/I406M, E24L/P175S/E198P/T211E/W226V/G253D/I316V, E24L/P175S/M201G/D275Q/I316V/L351M, E24L/P175S/M201G/I316V, E24L/P175S/T211E/C220L/T260V/D275Q/P330Q/D389E, E24L/P175S/T211E/G253D/I316V, E24L/P175S/T211E/I316V/P330Q, E24L/P175S/W226V/L323V/L351M, E24L/E198P/M201G, E24L/E198P/M201G/T211E, E24L/E198P/M201G/T211E/C220L/T260V, E24L/E198P/M201G/C220L/D275Q/D389E/L402I/I406M, E24L/E198P/M201G/W226V/P330Q/D389E, E24L/E198P/M201G/L351M, E24L/M201G/T211E/G253D/L323V/L351M/Q366H/D389E/L402I/K403R, E24L/M201G/W226V/G253D/L402I/K403R/I406M, E24L/W226V/P330Q/L351M/K403R, P175S/E198P/M201G/T211E/W226V/T260V/S264A/L323V/L402I/I406M, and P175S/E198P/W226V/T260V/L351M/L402I/K403R/I406M, wherein the positions are numbered with reference to SEQ ID NO: 1054. In some embodiments, the polypeptide sequence of the engineered glycosyltransferase comprises a sequence at least 90% identical to any of SEQ ID NOS: 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, and 2646. In some embodiments, the polypeptide sequence of the engineered glycosyltransferase comprises a sequence at least 95% identical to any of SEQ ID NOS: 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, and 2646. In some embodiments, the polypeptide sequence of the engineered glycosyltransferase comprises any of SEQ ID NOS: 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, and 2646.

The present invention also provides engineered glycosyltransferases, wherein the polypeptide sequence of the engineered glycosyltransferases comprise at least one mutation or mutation set at one or more positions selected from 21/127/129/161, 21/127/129/161/162, 21/127/129/162/199/200, 127/129/161/162/199, 127/129/161/199/200, 127/129/162, 156, 156/161, 156/161/162, 156/162/199, and 156/199/200, wherein the positions are numbered with reference to SEQ ID NO: 1002. In some embodiments, the polypeptide sequence of the engineered glycosyltransferase comprises at least one mutation or mutation set at one or more positions selected from 21Y/127H/129A/161S, 21Y/127H/129A/161S/162G, 21Y/127H/129A/162T/199H/200A, 127H/129A/162T, 127Q/129A/161S/162G/199H, 127Q/129A/161S/199H/200A, 156R, 156R/161S, 156R/161S/162G, 156R/161S/162T, 156R/162G/199H, and 156R/199H/200A, wherein the positions are numbered with reference to SEQ ID NO: 1002. In some embodiments, the polypeptide sequence of the engineered glycosyltransferase comprises at least one mutation or mutation set at one or more positions selected from W21Y/L127H/P129A/K161S, W21Y/L127H/P129A/K161S/N162G, W21Y/L127H/P129A/N162T/G199H/N200A, L127H/P129A/N162T, L127Q/P129A/K161S/N162G/G199H, L127Q/P129A/K161S/G199H/N200A, F156R, F156R/K161S, F156R/K161S/N162G, F156R/K161S/N162T, F156R/N162G/G199H, and F156R/G199H/N200A, wherein the positions are numbered with reference to SEQ ID NO: 1002. In some embodiments, the polypeptide sequence of the engineered glycosyltransferase comprises a sequence at least 90% identical to any of SEQ ID NOS: 2648, 2650, 2652, 2654, 2656, 2658, 2660, 2662, 2664, 2666, 2668, 2670, 2672, 2674, 2676, 2678, 2680, 2682, and 2684. In some embodiments, the polypeptide sequence of the engineered glycosyltransferase comprises a sequence at least 95% identical to any of SEQ ID NOS: 2648, 2650, 2652, 2654, 2656, 2658, 2660, 2662, 2664, 2666, 2668, 2670, 2672, 2674, 2676, 2678, 2680, 2682, and 2684. In some embodiments, the polypeptide sequence of the engineered glycosyltransferase comprises any of SEQ ID NOS: 2648, 2650, 2652, 2654, 2656, 2658, 2660, 2662, 2664, 2666, 2668, 2670, 2672, 2674, 2676, 2678, 2680, 2682, and 2684.

The present invention also provides engineered glycosyltransferases, wherein the polypeptide sequence of the engineered glycosyltransferases comprise at least one mutation or mutation set at one or more positions selected from 2/7/12/15/175/260/318, 7/12/400/435, 7/318/451, 12/15/57/71/175/260/400/402, 12/15/57/220/254/260/318/402, 12/15/57/318/402/435, 12/15/318/400/402/406, 12/57/175/451, 12/175/260/264/318/400, 12/175/400/402/406, 12/318/402/404/406/451, 12/318/402/404/451, 15/175/318/400/402, 57/175/220/260/264/402, 57/175/404, 57/220/260/400/402/406, 57/260/400/402/404, 57/400/402, 57/402, 152/192/195, 160/186/195, 195, 260, and 400/402, wherein the positions are numbered with reference to SEQ ID NO: 2600. In some embodiments, the polypeptide sequence of the engineered glycosyltransferase comprises at least one mutation or mutation set at one or more positions selected from 2-/7E/12S/15K/175S/260V/318D, 7E/12S/400Q/435V, 7E/318D/451N, 12S/15K/57K/71I/175S/260V/400Q/402I, 12S/15K/57K/220L/254K/260V/318D/402I, 12S/15K/57K/318D/402I/435V, 12S/15K/318D/400Q/402I/406M, 12S/57K/175S/451N, 12S/175S/260V/264A/318D/400Q, 12S/175S/400Q/402I/406M, 12S/318D/402I/404S/406M/451N, 12S/318D/402I/404S/451N, 15K/175S/318D/400Q/402I, 57K/175S/220L/260V/264A/402I, 57K/175S/404G, 57K/220L/260V/400Q/402I/406M, 57K/260V/400Q/402I/404S, 57K/400Q/402I, 57K/402I, 152V/192D/195P, 160V/186M/195P, 195P, 260V, and 400Q/402I, wherein the positions are numbered with reference to SEQ ID NO: 2600. In some embodiments, the polypeptide sequence of the engineered glycosyltransferase comprises at least one mutation or mutation set at one or more positions selected from H2-/H7E/A12S/R15K/P175S/T260V/E318D, H7E/A12S/E400Q/A435V, H7E/E318D/K451N, A12S/R15K/I57K/V71I/P175S/T260V/E400Q/L402I, A12S/R15K/I57K/C220L/T254K/T260V/E318D/L402I, A12S/R15K/I57K/E318D/L402I/A435V, A12S/R15K/E318D/E400Q/L402I/I406M, A12S/I57K/P175S/K451N, A12S/P175S/T260V/S264A/E318D/E400Q, A12S/P175S/E400Q/L402I/I406M, A12S/E318D/L402I/D404S/I406M/K451N, A12S/E318D/L402I/D404S/K451N, R15K/P175S/E318D/E400Q/L402I, I57K/P175S/C220L/T260V/S264A/L402I, I57K/P175S/D404G, I57K/C220L/T260V/E400Q/L402I/I406M, I57K/T260V/E400Q/L402I/D404S, I57K/E400Q/L402I, I57K/L402I, L152V/E192D/R195P, L160V/F186M/R195P, R195P, T260V, and E400Q/L402I, wherein the positions are numbered with reference to SEQ ID NO: 2600. In some embodiments, the polypeptide sequence of the engineered glycosyltransferase comprises at least one mutation or mutation set at one or more positions selected from 32, 135, 148, 152, 186, 237, 239, 240, 323, 325, 326, 327, 330, 331, and 356, wherein the positions are numbered with reference to SEQ ID NO: 2600.

In some embodiments, the polypeptide sequence of the engineered glycosyltransferase comprises at least one mutation or mutation set at one or more positions selected from 32R, 135A, 148A, 152V, 186V, 237T, 239E, 239F, 239Y, 240A, 240P, 323L, 325G, 325R, 326M, 327V, 330A, 331C, 331H, 331S, and 356G, wherein the positions are numbered with reference to SEQ ID NO: 2600. In some embodiments, the polypeptide sequence of the engineered glycosyltransferase comprises at least one mutation or mutation set at one or more positions selected from N32R, V135A, S148A, L152V, F186V, D237T, I239E, I239F, I239Y, T240A, T240P, V323L, H325G, H325R, F326M, A327V, P330A, R331C, R331H, R331S, and F356G, wherein the positions are numbered with reference to SEQ ID NO: 2600. In some embodiments, the polypeptide sequence of the engineered glycosyltransferase comprises a sequence at least 90% identical to any of SEQ ID NOS: 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, and 2774. I n some embodiments, the polypeptide sequence of the engineered glycosyltransferase comprises a sequence at least 95% identical to any of SEQ ID NOS: 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, and 2774. In some embodiments, the polypeptide sequence of the engineered glycosyltransferase comprises any of SEQ ID NOS: 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, and 2774.

The present invention also provides engineered glycosyltransferases, wherein the polypeptide sequence of the engineered glycosyltransferases comprise at least one mutation or mutation set at one or more positions selected from 14/23/274/326/329, 14/31/184/274/322/326/329/330, 14/56/184/185/194/238/239/274/329/399, 14/56/184/194/234/315/326/329/399/401, 14/56/194/238/315/325/326/329/330/399, 14/56/252/274/315/326/329/330/401, 14/184/185/194/234/325/326/329, 14/184/185/194/388/399/401, 14/184/194/355/399, 14/185/194/238/399, 14/185/236/238/239/274/322/326/329/355/399/401, 14/194, 14/322/326/330, 14/326/330, 14/355, 14/355/399, 23/31/147/184/185/238/252/325/329/330/388/401, 31/56/315/329/330, 65, 65/114/132/238, 65/238/240, 147/236/238/243/315/329/330/399/401, 185/194/236/239/325/326, 223/412, and 238, wherein the positions are numbered with reference to SEQ ID NO: 2718. In some embodiments, the polypeptide sequence of the engineered glycosyltransferase comprises at least one mutation or mutation set at one or more positions selected from 14R/23Q/274Q/326V/329A, 14R/31R/184A/274Q/322L/326V/329A/330H, 14R/56K/184A/185M/194P/238M/239A/274Q/329A/399Q, 14R/56K/184A/194P/234Y/315V/326V/329Q/399Q/401I, 14R/56K/194P/238M/315V/325M/326V/329A/330H/399Q, 14R/56K/252D/274Q/315V/326V/329A/330H/401I, 14R/184A/185M/194P/234Y/325M/326V/329A, 14R/184A/185M/194P/388E/399Q/401I, 14R/184A/194P/355G/399Q, 14R/185M/194P/238M/399Q, 14R/185M/236T/238M/239A/274Q/322L/326V/329Q/355G/399Q/401I, 14R/194P, 14R/322L/326V/330H, 14R/326V/330H, 14R/355G, 14R/355G/399Q, 23Q/31R/147A/184A/185M/238M/252D/325M/329A/330H/388E/401I, 31R/56K/315V/329A/330H, 65D, 65D/114E/132R/238M, 65D/238T/240S, 147A/236T/238M/243G/315V/329A/330H/399Q/401I, 185M/194P/236T/239A/325M/326V, 223T/412, and 238M, wherein the position are numbered with reference to SEQ ID NO: 2718. In some embodiments, the polypeptide sequence of the engineered glycosyltransferase comprises at least one mutation or mutation set at one or more positions selected from K14R/L23Q/D274Q/A326V/P329A, K14R/N31R/M184A/D274Q/V322L/A326V/P329A/R330H, K14R/I56K/M184A/F185M/R194P/I238M/T239A/D274Q/P329A/E399Q, K14R/I56K/M184A/R194P/F234Y/I315V/A326V/P329Q/E399Q/L401I, K14R/I56K/R194P/I238M/I315V/F325M/A326V/P329A/R330H/E399Q, K14R/I56K/G252D/D274Q/I315V/A326V/P329A/R330H/L401I, K14R/M184A/F185M/R194P/F234Y/F325M/A326V/P329A, K14R/M184A/F185M/R194P/D388E/E399Q/L401I, K14R/M184A/R194P/F355G/E399Q, K14R/F185M/R194P/I238M/E399Q, K14R/F185M/D236T/I238M/T239A/D274Q/V322L/A326V/P329Q/F355G/E399Q/L401I, K14R/R194P, K14R/V322L/A326V/R330H, K14R/A326V/R330H, K14R/F355G, K14R/F355G/E399Q, L23Q/N31R/S147A/M184A/F185M/I238M/G252D/F325M/P329A/R330H/D388E/L401I, N31R/I56K/I315V/P329A/R330H, E65D, E65D/Q114E/H132R/I238M, E65D/I238T/N240S, S147A/D236T/I238M/D243G/I315V/P329A/R330H/E399Q/L401I, F185M/R194P/D236T/T239A/F325M/A326V, S223T/I412S, and I238M, wherein the positions are numbered with reference to SEQ ID NO: 2718. In some embodiments, the polypeptide sequence of the engineered glycosyltransferase comprises at least one mutation or mutation set at one or more positions selected from 11, 45, 55, 56, 58, 65, 104, 113, 114, 132, 135, 138, 165, 238, 256, 273, 286, 309, 391, 422, 430, and 449, wherein the positions are numbered with reference to SEQ ID NO: 2718.

In some embodiments, the polypeptide sequence of the engineered glycosyltransferase comprises at least one mutation or mutation set at one or more positions selected from 11G, 11Q, 45F, 45V, 55L, 56T, 58R, 65N, 65S, 104L, 113V, 114R, 132Q, 132S, 135L, 138G, 138K, 165P, 238G, 256P, 273R, 286R, 309E, 309H, 391R, 422R, 430L, 430V, and 449F, wherein the positions are numbered with reference to SEQ ID NO: 2718. In some embodiments, the polypeptide sequence of the engineered glycosyltransferase comprises at least one mutation or mutation set at one or more positions selected from S11G, S11Q, L45F, L45V, I55L, I56T, K58R, E65N, E65S, M104L, L113V, Q114R, H132Q, H132S, N135L, N138G, N138K, E165P, I238G, E256P, E273R, N286R, K309E, K309H, N391R, K422R, E430L, E430V, and Y449F, wherein the positions are numbered with reference to SEQ ID NO: 2718. In some embodiments, the polypeptide sequence of the engineered glycosyltransferase comprises a sequence at least 90% identical to any of SEQ ID NOS: 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, and 2882. In some embodiments, the polypeptide sequence of the engineered glycosyltransferase comprises a sequence at least 95% identical to any of SEQ ID NOS: 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, and 2882. In some embodiments, the polypeptide sequence of the engineered glycosyltransferase comprises any of SEQ ID NOS: 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, and 2882.

The present invention also provides engineered glycosyltransferases, wherein the polypeptide sequence of the engineered glycosyltransferases comprise at least one mutation or mutation set at one or more positions selected from 23/31/185/324/401, 23/31/185/355, 31/134/185/252/274/324/388, 31/134/238/252/322/324/388, 31/134/252/324, 31/184/185/238/239/322, 31/236, 31/322, 31/388, 134/184/185/234/236/239/274/324/388, 184/185/322, 234/236/238/322/324/355, 236, 238/324/329/355, 322/324, and 324/329/355/401, numbered with reference to SEQ ID NO: 2814. In some embodiments, the polypeptide sequence of the engineered glycosyltransferase comprises at least one mutation or mutation set at one or more positions selected from 23Q/31R/85M/324G/401I, 23Q/31R/185M/355G, 31R/134A/185M/252D/274Q/324G/388E, 31R/134A/238E/252D/322L/324G/388E, 31R/134A/252D/324G, 31R/184A/185M/238Y/239A/322L, 31R/236T, 31R/322L, 31R/388E, 134A/184A/185M/234Y/236T/239A/274Q/324G/388E, 184A/185M/322L, 234Y/236T/238E/322L/324G/355G, 236T, 238Y/324G/329Q/355G, 322L/324G, and 324G/329Q/355G/401I, numbered with reference to SEQ ID NO: 2814. In some embodiments, the polypeptide sequence of the engineered glycosyltransferase comprises at least one mutation or mutation set at one or more positions selected from L23Q/N31R/F185M/H324G/L401I, L23Q/N31R/F185M/F355G, N31R/V134A/F185M/G252D/D274Q/H324G/D388E, N31R/V134A/M238E/G252D/V322L/H324G/D388E, N31R/V134A/G252D/H324G, N31R/M184A/F185M/M238Y/T239A/V322L, N31R/D236T, N31R/V322L, N31R/D388E, V134A/M184A/F185M/F234Y/D236T/T239A/D274Q/H324G/D388E, M184A/F185M/V322L, F234Y/D236T/M238E/V322L/H324G/F355G, D236T, M238Y/H324G/A329Q/F355G, V322L/H324G, and H324G/A329Q/F355G/L401I, numbered with reference to SEQ ID NO: 2814. In some embodiments, the polypeptide sequence of the engineered glycosyltransferase comprises at least one mutation or mutation set at one or more positions selected from 122, 164, 176, 177, 316, 325, 400, 425, 426, 427, 440, and 446, numbered with reference to SEQ ID NO: 2814. In some embodiments, the polypeptide sequence of the engineered glycosyltransferase comprises at least one mutation or mutation set at one or more positions selected from 122L, 164H, 164M, 164R, 176K, 176L, 176N, 176R, 177A, 316R, 325L, 400V, 425R, 426A, 426R, 427R, 440R, and 446R, numbered with reference to SEQ ID NO: 2814. In some embodiments, the polypeptide sequence of the engineered glycosyltransferase comprises at least one mutation or mutation set at one or more positions selected from I122L, V164H, V164M, V164R, V176K, V176L, V176N, V176R, E177A, G316R, M325L, T400V, K425R, S426A, S426R, I427R, I440R, and S446R, numbered with reference to SEQ ID NO: 2814. In some embodiments, the polypeptide sequence of the engineered glycosyltransferase comprises a sequence at least 90% identical to any of SEQ ID NOS: 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2830, 2932, 2934, 2936, 2938, 2940, 2942, 2944, 2946, 2948, and 2950, numbered with reference to SEQ ID NO: 2814. In some embodiments, the polypeptide sequence of the engineered glycosyltransferase comprises a sequence at least 95% identical to any of SEQ ID NOS: 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2830, 2932, 2934, 2936, 2938, 2940, 2942, 2944, 2946, 2948, and 2950. In some embodiments, the polypeptide sequence of the engineered glycosyltransferase comprises any of SEQ ID NOS: 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2830, 2932, 2934, 2936, 2938, 2940, 2942, 2944, 2946, 2948, and 2950.

The present invention also provides engineered glycosyltransferases, wherein the polypeptide sequence of the engineered glycosyltransferases comprise at least one mutation or mutation set at one or more positions selected from 11, 11/45/58/132/138/286, 11/58, 11/58/65/104/107/138/286, 11/58/65/107/135/223/286/391/430, 11/58/65/135/138, 11/58/104/107/114/138/223/391, 11/58/114/286/309/391, 11/58/132/165/286/391/422/430, 11/58/138/309, 11/65/104/107/138/165/286/391/430, 11/65/107/135/165/391/430, 11/65/132/135/138/223/391, 11/65/132/135/252, 11/65/132/391/430, 11/65/135/138, 11/104/132/138/309/391, 11/104/132/138/391, 11/107/114/223/309/430, 11/107/138, 11/114/135/138/223, 11/114/223/252/286/391, 11/132/135/138/223/286, 11/132/138/223/286/391, 11/138/165/223/309, 58/65/138, 58/65/138/165, 58/65/165/309/430, 58/104/114/165/391, 107/114/132/138, 107/430, 135/138/165/309/430, and 223/309, wherein the positions are numbered with reference to SEQ ID NO: 2884. In some embodiments, the polypeptide sequence of the engineered glycosyltransferase comprises at least one mutation or mutation set at one or more positions selected from 11G/45V/58R/132Q/138G/

286R, 11G/58R/104L/107G/114R/138K/223T/391R, 11G/58R/114R/286R/309H/391R, 11G/58R/132Q/165P/286R/391R/422S/430L, 11G/65N/132Q/391R/430L, 11G/104L/132Q/138G/309H/391R, 11G/107G/114R/223T/309H/430L, 11Q, 11Q/58R, 11Q/58R/65N/104L/107G/138G/286R, 11Q/58R/65N/107G/135L/223T/286R/391R/430L, 11Q/58R/65N/135L/138G, 11Q/58R/138G/309E, 11Q/65N/104L/107G/138G/165P/286R/391R/430L, 11Q/65N/107G/135L/165P/391R/430L, 11Q/65N/132Q/135L/138G/223T/391R, 11Q/65N/132Q/135L/252D, 11Q/65N/135L/138G, 11Q/104L/132Q/138K/391R, 11Q/107G/138G, 11Q/114R/135L/138G/223T, 11Q/114R/223T/252D/286R/391R, 11Q/132Q/135L/138K/223T/286R, 11Q/132Q/138G/223T/286R/391R, 11Q/138K/165P/223T/309H, 58R/65N/138G/165P, 58R/65N/138K, 58R/65N/165P/309H/430L, 58R/104L/114R/165P/391R, 107G/114R/132Q/138G, 107G/430L, 135L/138G/165P/309H/430L, and 223T/309E, wherein the positions are numbered with reference to SEQ ID NO: 2884. In some embodiments, the polypeptide sequence of the engineered glycosyltransferase comprises at least one mutation or mutation set at one or more positions selected from S11G/L45V/K58R/H132Q/N138G/N286R, S11G/K58R/M104L/P107G/Q114R/N138K/S223T/N391R, S11G/K58R/Q114R/N286R/K309H/N391R, S11G/K58R/H132Q/E165P/N286R/N391R/K422S/E430L, S11G/E65N/H132Q/N391R/E430L, S11G/M104L/H132Q/N138G/K309H/N391R, S11G/P107G/Q114R/S223T/K309H/E430L, S11Q, S11Q/K58R, S11Q/K58R/E65N/M104L/P107G/N138G/N286R, S11Q/K58R/E65N/P107G/N135L/S223T/N286R/N391R/E430L, S11Q/K58R/E65N/N135L/N138G, S11Q/K58R/N138G/K309E, S11Q/E65N/M104L/P107G/N138G/E165P/N286R/N391R/E430L, S11Q/E65N/P107G/N135L/E165P/N391R/E430L, S11Q/E65N/H132Q/N135L/N138G/S223T/N391R, S11Q/E65N/H132Q/N135L/G252D, S11Q/E65N/N135L/N138G, S11Q/M104L/H132Q/N138K/N391R, S11Q/P107G/N138G, S11Q/Q114R/N135L/N138G/S223T, S11Q/Q114R/S223T/G252D/N286R/N391R, S11Q/H132Q/N135L/N138K/S223T/N286R, S11Q/H132Q/N138G/S223T/N286R/N391R, S11Q/N138K/E165P/S223T/K309H, K58R/E65N/N138G/E165P, K58R/E65N/N138K, K58R/E65N/E165P/K309H/E430L, K58R/M104L/Q114R/E165P/N391R, P107G/Q114R/H132Q/N138G, P107G/E430L, N135L/N138G/E165P/K309H/E430L, and S223T/K309E, wherein the positions are numbered with reference to SEQ ID NO: 2884. In some embodiments, the polypeptide sequence of the engineered glycosyltransferase comprises a sequence at least 90% identical to any of SEQ ID NOS: 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, and 3016. In some embodiments, the polypeptide sequence of the engineered glycosyltransferase comprises a sequence at least 95% identical to any of SEQ ID NOS: 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, and 3016. In some embodiments, the polypeptide sequence of the engineered glycosyltransferase comprises any of SEQ ID NOS: 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, and 3016.

The present invention also provides engineered glycosyltransferases, wherein the polypeptide sequence of the engineered glycosyltransferases comprise at least one mutation or mutation set at one or more positions selected from 8/448, 58/107/122/176/236/324/325/400/426/427, 58/107/122/236/324/400/425/446, 58/107/122/322/400/425/427/440/446, 58/107/164/400, 58/107/236/400, 58/107/400, 58/122/164/236/446, 58/122/176/236/400/446, 58/122/176/322/324/426/427, 58/122/322/325, 58/122/325, 58/122/440, 58/164/176, 58/164/324/425/427, 58/176/236, 58/236, 107/122/236/425/426/446, 107/164/236/400/446, 107/176/322/325/440/446, 107/176/400/425/427/440, 107/236, 107/440, 122/164/176/324/400, 122/164/400/440, 122/164/400/440/446, 122/176/236/400, 122/176/324/400/440, 122/400, 122/425/426/446, 122/440/446, 139, 139/252, 164, 164/271/425/426, 164/322/324/325/400/425/440/446, 164/400, 176/400, 189, and 324/400/425/426/440/446, wherein the positions are numbered with reference to SEQ ID NO: 3016. In some embodiments, the polypeptide sequence of the engineered glycosyltransferase comprises at least one mutation or mutation set at one or more positions selected from 8S/448A, 58R/107G/122L/176R/236T/324G/325L/400V/426R/427R, 58R/107G/122L/236T/324G/400V/425R/446R, 58R/107G/122L/322L/400V/425R/427R/440R/446R, 58R/107G/164H/400V, 58R/107G/236T/400V, 58R/107G/400V, 58R/122L/164H/236T/446R, 58R/122L/176R/236T/400V/446R, 58R/122L/176R/322L/324G/426A/427R, 58R/122L/322L/325L, 58R/122L/325L, 58R/122L/440R, 58R/164H/176R, 58R/164H/324G/425R/427R, 58R/176R/236T, 58R/236T, 107G/122L/236T/425R/426A/446R, 107G/164H/236T/400V/446R, 107G/176R/322L/325L/440R/446R, 107G/176R/400V/425R/427R/440R, 107G/236T, 107G/440R, 122L/164H/176R/324G/400V, 122L/164H/400V/440R, 122L/164H/400V/440R/446R, 122L/176R/236T/400V, 122L/176R/324G/400V/440R, 122L/400V, 122L/425R/426R/446R, 122L/440R/446R, 139V, 139V/252D, 164H, 164H/271G/425R/426R, 164H/322L/324G/325L/400V/425R/440R/446R, 164H/400V, 176R/400V, 189R, and 324G/400V/425R/426R/440R/446R, wherein the positions are numbered with reference to SEQ ID NO: 3016. In some embodiments, the polypeptide sequence of the engineered glycosyltransferase comprises at least one mutation or mutation set at one or more positions selected from G8S/K448A, K58R/P107G/I122L/V176R/D236T/H324G/M325L/T400V/S426R/I427R, K58R/P107G/I122L/D236T/H324G/T400V/K425R/S446R, K58R/P107G/I122L/V322L/T400V/K425R/I427R/I440R/S446R, K58R/P107G/V164H/T400V, K58R/P107G/D236T/T400V, K58R/P107G/T400V, K58R/I122L/V164H/D236T/S446R, K58R/I122L/V176R/D236T/T400V/S446R, K58R/I122L/V176R/V322L/H324G/S426A/I427R, K58R/I122L/V322L/M325L, K58R/I122L/M325L, K58R/I122L/I440R, K58R/V164H/V176R, K58R/V164H/H324G/K425R/I427R, K58R/V176R/D236T, K58R/D236T, P107G/I122L/D236T/K425R/S426A/S446R, P107G/V164H/D236T/T400V/S446R, P107G/V176R/V322L/M325L/I440R/S446R, P107G/V176R/T400V/K425R/I427R/I440R, P107G/D236T, P107G/I440R, I122L/V164H/V176R/H324G/T400V, I122L/V164H/T400V/I440R, I122L/V164H/T400V/I440R/S446R, I122L/V176R/D236T/T400V, I122L/V176R/H324G/T400V/I440R, I122L/T400V, I122L/K425R/S426R/S446R, I122L/I440R/S446R, I139V, I139V/G252D, V164H, V164H/S271G/K425R/S426R, V164H/V322L/H324G/M325L/T400V/K425R/I440R/S446R, V164H/T400V, V176R/T400V, P189R, and H324G/T400V/K425R/S426R/I440R/S446R, wherein the positions are numbered with reference to SEQ ID NO: 3016. In some embodiments, the polypeptide sequence of the engineered glycosyltransferase comprises at least one mutation or mutation set at one or more positions selected from 9, 65, 106, 115, 116, 172, 178, 200, 210, 213, 240, 242, 245, 255, 324/423, 385, 408, 409, 411, 412, 415, 416, 423, and 447, wherein the positions are numbered with reference to SEQ ID NO: 3016. In some embodiments, the polypeptide sequence of the engineered glycosyltransferase comprises at least one mutation or mutation set at one or more positions selected from 9C, 9M, 655, 106A, 115D, 115R, 116V, 172R, 172S, 178K, 200A, 200T, 200V, 210L, 210V, 213G, 240C, 240E, 240L, 240P, 240V, 242I, 242Y, 245M, 255P, 324R/423R, 385R, 408P, 409L, 411Q, 412R, 415A, 415H, 415K, 415R, 416R, 423A, 423R, 447L, and 447R, wherein the positions are numbered with reference to SEQ ID NO: 3016. In some embodiments, the polypeptide sequence of the engineered glycosyltransferase comprises at least one mutation or mutation set at one or more positions selected from S9C, S9M, N65S, K106A, N115D, N115R, L116V, N172R, N172S, Q178K, G200A, G200T, G200V, E210L, E210V, A213G, N240C, N240E, N240L, N240P, N240V, A242I, A242Y, K245M, D255P, H324R/N423R, V385R, E408P, T409L, E411Q, I412R, G415A, G415H, G415K, G415R, K416R, N423A, N423R, N447L, and N447R, wherein the positions are numbered with reference to SEQ ID NO: 3016. In some embodiments, the polypeptide sequence of the engineered glycosyltransferase comprises a sequence at least 90% identical to any of SEQ ID NOS: 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, and 3180. In some embodiments, the polypeptide sequence of the engineered glycosyltransferase comprises a sequence at least 95% identical to any of SEQ ID NOS: 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, and 3180. In some embodiments, the polypeptide sequence of the engineered glycosyltransferase comprises any of SEQ ID NOS: 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, and 3180.

The present invention also provides engineered glycosyltransferases, wherein the polypeptide sequence of the engineered glycosyltransferases comprise at least one mutation or mutation set at one or more positions selected from, 8, 8/107/139/164/415/416/440/448, 8/107/139/255/322/325/415/416/440/448, 8/107/164/255, 8/107/164/423/440, 8/139, 8/139/164/200/236/240/322/440/448, 8/139/164/236/416/423/440, 8/139/189/240/325/416, 8/139/200/236/240/255/423, 8/164, 8/164/189/200/322/324/325/416/448, 8/164/240/423, 8/164/252/255/448, 8/164/448, 8/236/240/252/448, 8/240/423, 8/252/255/322/325/448, 12/164/440, 107/139, 107/139/200/240/322/324/325/448, 107/236/240/325/440, 107/240/252/423/448, 107/423, 139, 139/164/236/240, 139/255/325/415/440, 164/189, 164/189/236/240, 164/189/240/252/415/423, 164/200/236, 164/200/236/240/324/416/440, 164/200/236/255/322/324/423/440, 164/236, 164/236/240/440, 164/236/423, 164/322/325, 164/322/325/416/423, 164/416/448, 200/236/322/325/416, 200/322/325/415/448, 236/415/416, 240, 240/252/255/322/415/416, 240/252/255/415/448, 255/423, 325, and 415/416/448, wherein the positions are numbered with reference to SEQ ID NO: 3082. In some embodiments, the polypeptide sequence of the engineered glycosyltransferase comprises at least one mutation or mutation set at one or more positions selected from 2-, 8S, 8S/107G/139V/164H/415A/416R/440R/448A, 8S/107G/139V/255P/322L/325L/415A/416R/440R/448A, 8S/107G/164H/255P, 8S/107G/164H/423R/440R, 8S/139V, 8S/139V/164H/200A/236T/240E/322L/440R/448A, 8S/139V/164H/236T/416R/423R/440R, 8S/139V/189R/240E/325L/416R, 8S/139V/200A/236T/240E/255P/423R, 8S/139V/255P/415A/416R, 8S/164H, 8S/164H/189R/200A/322L/324G/325L/416R/448A, 8S/164H/240E/423R, 8S/164H/252D/255P/448A, 8S/164H/448A, 8S/236T/240E/252D/448A, 8S/240E/423R, 8S/252D/255P/322L/325L/448A, 12S/164H/440R, 107G/139V, 107G/139V/200A/240E/322L/324G/325L/448A, 107G/236T/240E/325L/440R, 107G/240E/252D/423R/448A, 107G/423R, 139V, 139V/164H/236T/240E, 139V/255P/325L/415A/440R, 164H/189R, 164H/189R/236T/240E, 164H/189R/240E/252D/415A/423R, 164H/200A/236T, 164H/200A/236T/240E/324G/416R/440R, 164H/200A/236T/255P/322L/324G/423R/440R, 164H/236T, 164H/236T/240E/440R, 164H/236T/423R, 164H/322L/325L, 164H/322L/325L/416R/423R, 164H/416R/448A, 200A/236T/322L/325L/416R, 200A/322L/325L/415A/448A, 236T/415A/416R, 240E, 240E/252D/255P/322L/415A/416R, 240E/252D/255P/415A/448A, 255P/423R, 325L, and 415A/416R/448A, wherein the positions are numbered with reference to SEQ ID NO: 3082. In some embodiments, the polypeptide sequence of the engineered glycosyltransferase comprises at least one mutation or mutation set at one or more positions selected from H2-, G8S, G8S/P107G/I139V/V164H/G415A/K416R/I440R/K448A, G8S/P107G/I139V/D255P/V322L/M325L/G415A/K416R/I440R/K448A, G8S/P107G/V164H/D255P, G8S/P107G/V164H/N423R/I440R, G8S/I139V, G8S/I139V/V164H/G200A/D236T/N240E/V322L/I440R/K448A, G8S/I139V/V164H/D236T/K416R/N423R/I440R, G8S/I139V/P189R/N240E/M325L/K416R, G8S/I139V/G200A/D236T/N240E/D255P/N423R, G8S/I139V/D255P/G415A/K416R, G8S/V164H, G8S/V164H/P189R/G200A/V322L/H324G/M325L/K416R/K448A, G8S/V164H/N240E/N423R, G8S/V164H/G252D/D255P/K448A, G8S/V164H/K448A, G8S/D236T/N240E/G252D/K448A, G8S/N240E/N423R, G8S/G252D/D255P/V322L/M325L/K448A, T12S/V164H/I440R, P107G/I139V, P107G/I139V/G200A/N240E/V322L/H324G/M325L/K448A, P107G/D236T/N240E/M325L/I440R, P107G/N240E/G252D/N423R/K448A, P107G/N423R, I139V, I139V/V164H/D236T/N240E, I139V/D255P/M325L/G415A/I440R, V164H/P189R, V164H/P189R/D236T/N240E, V164H/P189R/N240E/G252D/G415A/N423R, V164H/G200A/D236T, V164H/G200A/D236T/N240E/H324G/K416R/I440R, V164H/G200A/D236T/D255P/V322L/H324G/N423R/I440R, V164H/D236T, V164H/D236T/N240E/I440R, V164H/D236T/N423R, V164H/V322L/M325L, V164H/V322L/M325L/K416R/N423R, V164H/K416R/K448A, G200A/

D236T/V322L/M325L/K416R, G200A/V322L/M325L/ G415A/K448A, D236T/G415A/K416R, N240E, N240E/ G252D/D255P/V322L/G415A/K416R, N240E/G252D/ D255P/G415A/K448A, D255P/N423R, M325L, and G415A/K416R/K448A, wherein the positions are numbered with reference to SEQ ID NO: 3082. In some embodiments, the polypeptide sequence of the engineered glycosyltransferase comprises at least one mutation or mutation set at one or more positions selected from 2, 3, 8, 34, 72, 73, 75, 113, 114, 186, 189, 221, 235, 237, 239, 256, 286, 299, 305, 309, 312, 313, 323, 355, 389, 406, 422, 438, and 446, wherein the positions are numbered with reference to SEQ ID NO: 3082. In some embodiments, the polypeptide sequence of the engineered glycosyltransferase comprises at least one mutation or mutation set at one or more positions selected from 2N, 2S, 2T, 31, 8S, 34R, 72Y, 73A, 73P, 73T, 73V, 75H, 113, 114V, 186G, 186I, 189S, 221K, 235M, 237L, 237M, 237V, 239A, 256I, 256L, 2565, 256T, 286L, 286S, 299A, 299L, 299R, 299V, 305G, 309R, 312S, 312T, 312V, 313D, 323P, 355A, 389F, 389G, 406F, 406G, 406N, 406Q, 422C, 422R, 4225, 438T, 446H, and 446P, wherein the positions are numbered with reference to SEQ ID NO: 3082. In some embodiments, the polypeptide sequence of the engineered glycosyltransferase comprises at least one mutation or mutation set at one or more positions selected from H2N, H2S, H2T, H3I, G8S, K34R, L72Y, H73A, H73P, H73T, H73V, P75H, L113I, Q114V, E186G, E186I, P189S, E221K, Q235M, P237L, P237M, P237V, T239A, E256I, E256L, E256S, E256T, N286L, N286S, E299A, E299L, E299R, E299V, D305G, K309R, L312S, L312T, L312V, E313D, D323P, F355A, D389F, D389G, T406F, T406G, T406N, T406Q, K422C, K422R, K422S, E438T, R446H, and R446P, wherein the positions are numbered with reference to SEQ ID NO: 3082. In some embodiments, the polypeptide sequence of the engineered glycosyltransferase comprises at least one mutation or mutation set at one or more positions selected from 20/126/128/155/161, 20/126/128/ 160/161, 20/126/128/160/161/198, 20/126/128/161, 20/126/ 128/161/198/199, 20/126/155/160/198, 20/126/155/161, 20/126/160, 20/126/160/161, 20/126/161, 20/128/155/160/ 161/198, 20/128/155/161/199, 20/128/155/199, 20/128/160/ 161/198, 20/155/160, 20/155/160/161, 20/155/161, 20/155/ 161/199, 20/160/161/198, 121/126/128/161/369, 126/128/ 155/160/161, 126/128/155/160/161/199, 126/128/155/161/ 199, 126/128/160/161/369, 126/128/160/198/369, 126/128/ 160/199/369, 126/128/160/369, 126/128/161/199/369, 126/ 128/161/369, 126/128/369, 126/160/161/199/369, 126/160/ 198/369, 126/196/198/369, 126/198/369, 126/199/369, 126/ 369, 128/155/160/161, 128/155/160/161/199, 128/155/160/ 198, 128/155/199, 128/160/161/369, 128/161/199/369, 128/ 198/199/369, 128/199/369, 128/369, 155/161/198/199, 155/ 199, 160/161/369, 161/198/369, 161/369, and 199/369, wherein the positions are numbered with reference to SEQ ID NO: 3082. In some embodiments, the polypeptide sequence of the engineered glycosyltransferase comprises at least one mutation or mutation set at one or more positions selected from 20Y/126H/128A/155R/161T, 20Y/126H/ 128A/161T, 20Y/126H/155R/160S/198P, 20Y/126H/160S, 20Y/126H/160S/161T, 20Y/126Q/128A/160S/161T, 20Y/ 126Q/128A/160S/161T/198H, 20Y/126Q/128A/161T/ 198H/199A, 20Y/126Q/155R/161G, 20Y/126Q/161G, 20Y/ 128A/155R/160S/161T/198H, 20Y/128A/155R/161T/ 199A, 20Y/128A/155R/199A, 20Y/128A/160S/161T/198P, 20Y/155R/160S, 20Y/155R/160S/161G, 20Y/155R/161T, 20Y/155R/161T/199A, 20Y/160S/161T/198H, 121F/126H/ 128A/161T/369N, 126H/128A/155R/160S/161T, 126H/ 128A/160S/198H/369N, 126H/128A/161G/199A/369N, 126H/128A/161G/369N, 126H/128A/369N, 126H/160S/ 161G/199A/369N, 126H/160S/198P/369N, 126H/196V/ 198P/369N, 126Q/128A/155R/160S/161T/199A, 126Q/ 128A/155R/161G/199A, 126Q/128A/160S/161T/369N, 126Q/128A/160S/199A/369N, 126Q/128A/160S/369N, 126Q/198P/369N, 126Q/199A/369N, 126Q/369N, 128A/ 155R/160S/161T, 128A/155R/160S/161T/199A, 128A/ 155R/160S/198P, 128A/155R/199A, 128A/160S/161G/ 369N, 128A/161G/199A/369N, 128A/198H/199A/369N, 128A/199A/369N, 128A/369N, 155R/161G/198H/199A, 155R/199A, 160S/161G/369N, 160S/161T/369N, 161T/ 198P/369N, 161T/369N, and 199A/369N, wherein the positions are numbered with reference to SEQ ID NO: 3082. In some embodiments, the polypeptide sequence of the engineered glycosyltransferase comprises at least one mutation or mutation set at one or more positions selected from W20Y/L126H/P128A/F155R/R161T, W20Y/L126H/ P128A/R161T, W20Y/L126H/F155R/K160S/G198P, W20Y/L126H/K160S, W20Y/L126H/K160S/R161T, W20Y/L126Q/P128A/K160S/R161T, W20Y/L126Q/ P128A/K160S/R161T/G198H, W20Y/L126Q/P128A/ R161T/G198H/N199A, W20Y/L126Q/F155R/R161G, W20Y/L126Q/R161G, W20Y/P128A/F155R/K160S/ R161T/G198H, W20Y/P128A/F155R/R161T/N199A, W20Y/P128A/F155R/N199A, W20Y/P128A/K160S/ R161T/G198P, W20Y/F155R/K160S, W20Y/F155R/ K160S/R161G, W20Y/F155R/R161T, W20Y/F155R/ R161T/N199A, W20Y/K160S/R161T/G198H, V121F/ L126H/P128A/R161T/P369N, L126H/P128A/F155R/ K160S/R161T, L126H/P128A/K160S/G198H/P369N, L126H/P128A/R161G/N199A/P369N, L126H/P128A/ R161G/P369N, L126H/P128A/P369N, L126H/K160S/ R161G/N199A/P369N, L126H/K160S/G198P/P369N, L126H/A196V/G198P/P369N, L126Q/P128A/F155R/ K160S/R161T/N199A, L126Q/P128A/F155R/R161G/ N199A, L126Q/P128A/K160S/R161T/P369N, L126Q/ P128A/K160S/N199A/P369N, L126Q/P128A/K160S/ P369N, L126Q/G198P/P369N, L126Q/N199A/P369N, L126Q/P369N, P128A/F155R/K160S/R161T, P128A/ F155R/K160S/R161T/N199A, P128A/F155R/K160S/ G198P, P128A/F155R/N199A, P128A/K160S/R161G/ P369N, P128A/R161G/N199A/P369N, P128A/G198H/ N199A/P369N, P128A/N199A/P369N, P128A/P369N, F155R/R161G/G198H/N199A, F155R/N199A, K160S/ R161G/P369N, K160S/R161T/P369N, R161T/G198P/ P369N, R161T/P369N, and N199A/P369N, wherein the positions are numbered with reference to SEQ ID NO: 3082. In some embodiments, the polypeptide sequence of the engineered glycosyltransferase comprises a sequence at least 90% identical to any of SEQ ID NOS: 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, and 3490.

In some embodiments, the polypeptide sequence of the engineered glycosyltransferase comprises a sequence at least 95% identical to any of SEQ ID NOS: 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, and 3490. In some embodiments, the polypeptide sequence of the engineered glycosyltransferase comprises any of SEQ ID NOS: 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, and 3490.

The present invention also provides engineered glycosyltransferases, wherein the polypeptide sequence of the engineered glycosyltransferases comprise at least one mutation or mutation set at one or more positions selected from 106/164/172/200/409, 106/164/172/210/240/415, 106/164/172/242/409/416, 106/164/200/210/242, 106/164/200/210/415, 106/164/200/240/408/409/416, 106/164/210/240/408/409/416, 106/164/210/408/409, 106/164/240/415, 106/164/409/415/423, 106/172/200/210/240/242/408/415/416/423, 106/172/200/210/242, 106/172/240, 106/172/240/242/409/415, 106/172/242, 106/172/242/416/423, 106/172/408/409, 106/172/409/423, 106/200/210/409, 106/210/240, 106/210/240/408/415, 106/240/242, 106/240/242/409, 106/242/408/409, 164/172/200/210/242/409, 164/172/240/242/415, 164/172/242/408, 164/200/408/415/416, 164/240/242/408, 164/240/242/415/423, 164/423, 172/200/210/240/408, 172/200/240, 172/200/408/416, 172/210/415, 172/240, 172/240/242/415, 172/240/409, 200/210/240/242/409, 200/240/242/407, 200/242/415/416/423, 200/408/409, 210/240, 240, 240/242, 240/242/408/416, 240/242/415/423, 240/408, 240/415, and 409/415, wherein the positions are numbered with reference to SEQ ID NO: 3244. In some embodiments, the polypeptide sequence of the engineered glycosyltransferase comprises at least one mutation or mutation set at one or more positions selected from 106A/164H/172R/200A/409L, 106A/164H/172R/210V/240E/415R, 106A/164H/172R/242I/409L/416R, 106A/164H/200A/210V/242I, 106A/164H/200A/210V/415A, 106A/164H/200A/240E/408P/409L/416R, 106A/164H/210V/240E/408P/409L/416R, 106A/164H/210V/408P/409L, 106A/164H/240E/415A, 106A/164H/409L/415A/423R, 106A/172R/200A/210V/240E/242I/408P/415A/416R/423R, 106A/172R/200A/210V/242I, 106A/172R/240E, 106A/172R/240E/242I/409L/415R, 106A/172R/242I, 106A/172R/242I/416R/423R, 106A/172R/408P/409L, 106A/172R/409L/423R, 106A/200A/210V/409L, 106A/210V/240E, 106A/210V/240E/408P/415R, 106A/240E/242I, 106A/240E/242I/409L, 106A/242I/408P/409L, 164H/172R/200A/210V/242I/409L, 164H/172R/240E/242I/415R, 164H/172R/242I/408P, 164H/200A/408P/415A/416R, 164H/240E/242I/408P, 164H/240E/242I/415R/423R, 164H/423R, 172R/200A/210V/240E/408P, 172R/200A/240E, 172R/200A/408P/416R, 172R/210V/415A, 172R/240E, 172R/240E/242I/415R, 172R/240E/409L, 200A/210V/240E/242I/409L, 200A/240E/242I/407S, 200A/242I/415A/416R/423R, 200A/408P/409L, 210V/240E, 240E, 240E/242I, 240E/242I/408P/416R, 240E/242I/415A/423R, 240E/408P, 240E/415R, and 409L/415R, wherein the positions are numbered with reference to SEQ ID NO: 3244. In some embodiments, the polypeptide sequence of the engineered glycosyltransferase comprises at least one mutation or mutation set at one or more positions selected from K106A/V164H/N172R/G200A/T409L, K106A/V164H/N172R/E210V/N240E/G415R, K106A/V164H/N172R/A242I/T409L/K416R, K106A/V164H/G200A/E210V/A242I, K106A/V164H/G200A/E210V/G415A, K106A/V164H/G200A/N240E/E408P/T409L/K416R, K106A/V164H/E210V/N240E/E408P/T409L/K416R, K106A/V164H/E210V/E408P/T409L, K106A/V164H/N240E/G415A, K106A/V164H/T409L/G415A/N423R, K106A/N172R/G200A/E210V/N240E/A242I/E408P/G415A/K416R/N423R, K106A/N172R/G200A/E210V/A242I, K106A/N172R/N240E, K106A/N172R/N240E/A242I/T409L/G415R, K106A/N172R/A242I, K106A/N172R/A242I/K416R/N423R, K106A/N172R/E408P/T409L, K106A/N172R/T409L/N423R, K106A/G200A/E210V/T409L, K106A/E210V/N240E, K106A/E210V/N240E/E408P/G415R, K106A/N240E/A242I, K106A/N240E/A242I/T409L, K106A/A242I/E408P/T409L, V164H/N172R/G200A/E210V/A242I/T409L, V164H/N172R/N240E/A242I/G415R, V164H/N172R/A242I/E408P, V164H/G200A/E408P/G415A/K416R, V164H/N240E/A242I/E408P, V164H/N240E/A242I/G415R/N423R, V164H/N423R, N172R/G200A/E210V/N240E/E408P, N172R/G200A/N240E, N172R/G200A/E408P/K416R, N172R/E210V/G415A, N172R/N240E, N172R/N240E/A242I/G415R, N172R/N240E/T409L, G200A/E210V/N240E/A242I/T409L, G200A/N240E/A242I/G407S, G200A/A242I/G415A/K416R/N423R, G200A/E408P/T409L, E210V/N240E, N240E, N240E/A242I, N240E/A242I/E408P/K416R, N240E/A242I/G415A/N423R, N240E/E408P, N240E/G415R, and T409L/G415R, wherein the positions are numbered with reference to SEQ ID NO: 3244. In some embodiments, the polypeptide sequence of the engineered glycosyltransferase comprises at least one mutation or mutation set at one or more positions selected from 14, 35, 42, 46, 49, 105, 134, 143, 179, 181, 232, 278, 290, 336, 373, 381, 401, and 441, wherein the positions are numbered with reference to SEQ ID NO: 3244. In some embodiments, the polypeptide sequence of the engineered glycosyltransferase comprises at least one mutation or mutation set at one or more positions selected from 14K, 35D, 42F, 42I, 42V, 46T, 46V, 49A, 49M, 49P, 49Q, 49S, 105A, 134A, 134C, 134S, 143P, 179A, 179D, 179T, 181L, 232T, 278I, 278L, 290L, 336A, 373R, 381G, 401V, 441I, and 441R, wherein the positions are numbered with reference to SEQ ID NO: 3244. In some embodiments, the polypeptide sequence of the engineered glycosyltransferase comprises at least one mutation or mutation set at one or more positions selected from R14K, Q35D, L42F, L42I, L42V, C46T, C46V, L49A, L49M, L49P, L49Q, L49S, S105A, V134A, V134C, V134S, K143P, V179A, V179D, V179T, M181L, P232T, V278I, V278L, I290 μL, S336A, K373R, A381G, L401V, Q441I, and Q441R, wherein the positions are numbered with reference to SEQ ID NO: 3244.

In some embodiments, the polypeptide sequence of the engineered glycosyltransferase comprises a sequence at least 90% identical to any of SEQ ID NOS: 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, and 3652. In some embodiments, the polypeptide sequence of the engineered glycosyltransferase comprises a sequence at least 95% identical to any of SEQ ID NOS: 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, and 3652. In some embodiments, the polypeptide sequence of the engineered glycosyltransferase comprises any of SEQ ID NOS: 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, and 3652.

The present invention also provides engineered glycosyltransferases, wherein the polypeptide sequence of the engineered glycosyltransferases comprise at least one mutation or mutation set at one or more positions selected from 21, 91, 125, 127, 130/187, 143, 143/150, 145, 152, 156, 186, 187, 195, 197, 200, 201, 202, 264, 268, 364, 365, and 415, wherein the positions are numbered with reference to SEQ ID NO: 3346. In some embodiments, the polypeptide sequence of the engineered glycosyltransferase comprises at least one mutation or mutation set at one or more positions selected from 21M, 21P, 91M, 125C, 125M, 125V, 127G, 130T/187Q, 143H, 143P/150S, 145W, 152L, 156P, 156Q, 186N, 186V, 187S, 195F, 195G, 195R, 195S, 195T, 195Y, 197D, 197L, 197Q, 197W, 200E, 200P, 200R, 200T, 201A, 201R, 201S, 201W, 202A, 202W, 264S, 264T, 268F, 268Q, 268W, 364S, 364W, 365L, and 415D, wherein the positions are numbered with reference to SEQ ID NO: 3346. In some embodiments, the polypeptide sequence of the engineered glycosyltransferase comprises at least one mutation or mutation set at one or more positions selected from L21M, L21P, P91M, F125C, F125M, F125V, Q127G, A130T/K187Q, K143H, K143P/A150S, L145W, F152L, F156P, F156Q, E186N, E186V, K187S, L195F, L195G, L195R, L195S, L195T, L195Y, P197D, P197L, P197Q, P197W, G200E, G200P, G200R, G200T, G201A, G201R, G201S, G201W, I202A, I202W, F264S, F264T, Y268F, Y268Q, Y268W, M364S, M364W, Q365L, and G415D, wherein the positions are numbered with reference to SEQ ID NO: 3346. In some embodiments, the polypeptide sequence of the engineered glycosyltransferase comprises a sequence at least 90% identical to any of SEQ ID NOS: 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, and 3850. In some embodiments, the polypeptide sequence of the engineered glycosyltransferase comprises a sequence at least 95% identical to any of SEQ ID NOS: 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, and 3850. In some embodiments, the polypeptide sequence of the engineered glycosyltransferase any of SEQ ID NOS: 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, and 3850.

The present invention also provides engineered glycosyltransferases, wherein the polypeptide sequence of the engineered glycosyltransferases comprise at least one mutation or mutation set at one or more positions selected from 2/5/113/186/237/406, 2/73/186/237, 2/189/286, 2/286/355/416/422, 5/34/73/113/406, 5/73/186/406, 5/113/237/406, 5/186/237/245/256/406, 5/186/237/406, 5/256/406, 34/113/186/237/406, 72/73/172/235/240/242/438, 72/172/239/240/242/408, 72/172/240/242, 73/172, 73/172/235/239/240, 73/172/235/239/242, 73/172/239/240, 73/172/239/240/242, 73/172/240/242/408, 73/172/240/408, 73/186/237/406, 73/235/240/323, 73/235/240/408, 73/237, 73/239/242, 113/186/406, 172, 172/188/323, 172/235, 172/235/239/240/242, 172/235/239/408, 172/235/240, 172/235/240/242/438, 172/239/240/242/323/408, 172/240, 172/240/299/323, 186, 186/237, 186/237/286, 186/406, 189/333/355/421, 235/239/240, 235/240/242, 237, 239/240, 239/240/242/256/323, 239/240/242/323/408, 239/240/408, 239/242/408, 240/242/256/438, and 242/408, wherein the positions are numbered with reference to SEQ ID NO: 3502. In some embodiments, the polypeptide sequence of the engineered glycosyltransferase comprises at least one mutation or mutation set at one or more positions selected from 2-/5N/113I/186G/237V/406Q, 2-/73A/186G/237V, 2S/189S/286Q, 2S/286Q/355A/416R/422R, 5N/34R/73A/113I/406N, 5N/73A/186G/406N, 5N/113I/237V/406N, 5N/186G/237V/245T/256I/406Q, 5N/186G/237V/406Q, 5N/256L/406Q, 34R/113I/186G/237L/406N, 72Y/73P/172R/235M/240E/242I/438T, 72Y/172R/239A/240E/242I/408P, 72Y/172R/240E/242I, 73A/186G/237L/406Q, 73A/237V, 73P/172R, 73P/172R/235M/239A/240E, 73P/172R/235M/239A/242I, 73P/172R/239A/240E, 73P/172R/239A/240E/242I, 73P/172R/240E/242I/408P, 73P/172R/240E/408P, 73P/235M/240E/323P, 73P/235M/240E/408P, 73P/239A/242I, 113I/186G/406Q, 172R, 172R/188G/323P, 172R/235M, 172R/235M/239A/240E/242I, 172R/235M/239A/408P, 172R/235M/240E, 172R/235M/240E/242I/438T, 172R/239A/240E/242I/323P/408P, 172R/240E, 172R/240E/299A/323P, 186G, 186G/237L, 186G/237V/286S, 186G/406N, 186G/406Q, 189S/333H/355A/421Q, 235M/239A/240E, 235M/240E/242I, 237L, 239A/240E, 239A/240E/242I/256S/323P, 239A/240E/242I/323P/408P, 239A/240E/408P, 239A/242I/408P, 240E/242I/256S/438T, and 242I/408P, wherein the positions are numbered with reference to SEQ ID NO: 3502. In some embodiments, the polypeptide sequence of the engineered glycosyltransferase comprises at least one mutation or mutation set at one or more positions selected from H2-/H5N/L113I/E186G/P237V/T406Q, H2-/H73A/E186G/P237V, H2S/P189S/N286Q, H2S/N286Q/F355A/K416R/K422R, H5N/K34R/H73A/L113I/T406N, H5N/H73A/E186G/T406N, H5N/L113I/P237V/T406N, H5N/E186G/P237V/K245T/E256I/T406Q, H5N/E186G/P237V/T406Q, H5N/E256L/T406Q, K34R/L113I/E186G/P237L/T406N, L72Y/H73P/N172R/Q235M/N240E/A242I/E438T, L72Y/N172R/T239A/N240E/A242I/E408P, L72Y/N172R/N240E/A242I, H73A/E186G/P237L/T406Q, H73A/P237V, H73P/N172R, H73P/N172R/Q235M/T239A/N240E, H73P/N172R/Q235M/T239A/A242I, H73P/N172R/T239A/N240E, H73P/N172R/T239A/N240E/A242I, H73P/N172R/N240E/A242I/E408P, H73P/N172R/N240E/E408P, H73P/Q235M/N240E/D323P, H73P/Q235M/N240E/E408P, H73P/T239A/A242I, L113I/E186G/T406Q, N172R, N172R/E188G/D323P, N172R/Q235M, N172R/Q235M/T239A/N240E/A242I, N172R/Q235M/T239A/E408P, N172R/Q235M/N240E, N172R/Q235M/N240E/A242I/E438T, N172R/T239A/N240E/A242I/D323P/E408P, N172R/N240E, N172R/N240E/E299A/D323P, E186G, E186G/P237L, E186G/P237V/N286S, E186G/T406N, E186G/T406Q, P189S/N333H/F355A/S421Q, Q235M/T239A/N240E, Q235M/N240E/A242I, P237L, T239A/N240E, T239A/N240E/A242I/E256S/D323P, T239A/N240E/A242I/D323P/E408P, T239A/N240E/E408P, T239A/A242I/E408P, N240E/A242I/E256S/E438T, and A242I/E408P, wherein the positions are numbered with reference to SEQ ID NO: 3502. In some embodiments, the polypeptide sequence of the engineered glycosyltransferase comprises at least one mutation or mutation set at one or more positions selected from 96, 127, 132, 144, 153, 155, 156, 186, 187, 196, 199, and 200, wherein the positions are numbered with reference to SEQ ID NO: 3502. In some embodiments, the polypeptide sequence of the engineered glycosyltransferase comprises at least one mutation or mutation set at one or more positions selected from 96A, 96P, 127I, 127L, 127V, 132H, 132K, 132T, 144V, 153A, 153G, 155M, 156W, 186A, 186G, 186R, 187A, 187R, 187T, 196S, 199A, 199S, 199Y, and 200S, wherein the positions are numbered with reference to SEQ ID NO: 3502. In some embodiments, the polypeptide sequence of the engineered glycosyltransferase comprises at least one mutation or mutation set at one or more positions selected from G96A, G96P, Q127I, Q127L, Q127V, Q132H, Q132K, Q132T, I144V, S153A, S153G, F155M, F156W, E186A, E186G, E186R, K187A, K187R, K187T, A196S, N199A, N199S, N199Y, and A200S, wherein the positions are numbered with reference to SEQ ID NO: 3502.

In some embodiments, the polypeptide sequence of the engineered glycosyltransferase comprises a sequence at least 90% identical to any of SEQ ID NOS: 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, and 3898. In some embodiments, the polypeptide sequence of the engineered glycosyltransferase comprises a sequence at least 95% identical to any of SEQ ID NOS: 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, and 3898. In some embodiments, the polypeptide sequence of the engineered glycosyltransferase comprises any of SEQ ID NOS: 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, and 3898.

The present invention also provides engineered glycosyltransferases, wherein the polypeptide sequence of the engineered glycosyltransferases comprise at least one mutation or mutation set at one or more positions selected from 2/5/35/105/143/237/373/416/422, 2/5/35/143/232/237/416/422/441, 2/5/35/232/278/373/416, 2/5/105/143/232/373/416/422, 2/5/278, 2/105/143/232/237/278/373/441, 2/143/232/373/441, 2/143/373/441, 5/35/232/373/416/422, 5/105/232/237/373/416/441, 5/105/237/278/422/441, 5/105/237/416/422/441, 5/143/189/232/237/441, 5/143/232/237/278, 5/143/232/237/416/422, 5/143/232/373/422/441, 5/143/237/278/373/416/422, 5/143/373, 5/189/237/278/373/416/422/441, 5/232/416/422, 5/237/373/422, 5/373/416, 26/42, 26/42/46/49, 26/42/46/49/134, 26/42/46/49/134/186, 26/42/46/134, 26/42/49/134, 26/42/49/134/186/355, 26/42/49/134/401, 26/42/134/401, 26/49/134, 26/134, 26/134/186/355/401, 26/134/355, 26/134/401, 26/355/401, 35, 35/105/189/232/373/416, 42/46/49/97/134/401, 42/46/49/134, 42/46/49/134/186, 42/46/49/134/186/355, 42/46/49/134/235/355/401, 42/46/49/134/401, 42/46/49/186, 42/49/134/186/355, 42/49/134/186/401, 42/49/134/355/401, 42/134/186, 42/186/355, 46/49/134, 49/134/355, 105/143/232/237/373/416/422/441, 105/143/278/373, 105/189/237, 105/237/278/373/416/422, 105/237/373/422/441, 105/373, 105/373/441, 134/401, 143, 143/189, 143/189/232/422/441, 143/189/237/373/416/422, 143/232, 143/237, 143/237/422/441, 186/355, 189/232/373/416/422/441, 189/237/278/416/441, 232/237, 237/373, 237/373/441, and 237/422, wherein the positions are numbered with reference to SEQ ID NO: 3696. In some embodiments, the polypeptide sequence of the engineered glycosyltransferase comprises at least one mutation or mutation set at one or more positions selected from 2-/5N/35D/105A/143P/237V/373R/416R/422R, 2-/5N/35D/143P/232T/237L/416R/422R/441R, 2-/5N/35D/232T/278L/373R/416R, 2-/5N/105A/143P/232T/373R/416R/422R, 2-/5N/278L, 2-/105A/143P/232T/237L/278L/373R/441R, 2-/143P/232T/373R/441R, 2-/143P/373R/441R, 5N/35D/232T/373R/416R/422R, 5N/105A/232T/237L/373R/416R/441R, 5N/105A/237L/278I/422R/441R, 5N/105A/237V/416R/422R/441R, 5N/143P/189S/232T/237V/441R, 5N/143P/232T/237L/278L, 5N/143P/232T/237L/416R/422R, 5N/143P/232T/373R/422R/441R, 5N/143P/237L/278L/373R/416R/422R, 5N/143P/373R, 5N/189S/237V/278I/

373R/416R/422R/441R, 5N/232T/416R/422R, 5N/237L/373R/422R, 5N/373R/416R, 26V/42I/49Q/134C/186G/355A, 26V/42I/49Q/134C/401V, 26V/42V, 26V/42V/46V/49A, 26V/42V/46V/49A/134A, 26V/42V/46V/49A/134C/186G, 26V/42V/46V/134A, 26V/42V/49S/134C, 26V/42V/134C/401V, 26V/49Q/134A, 26V/134A, 26V/134A/186G/355A/401V, 26V/134C/355A, 26V/134T/401V, 26V/355A/401V, 35D, 35D/105A/189S/232T/373R/416R, 42I/46V/49A/134A, 42I/46V/49S/134C/186G, 42I/46V/49S/186G, 42V/46V/49A/134A/401V, 42V/46V/49A/134T/186G/355A, 42V/46V/49P/134C/235R/355A/401V, 42V/46V/49S/97P/134C/401V, 42V/49A/134C/186G/355A, 42V/49S/134A/186G/401V, 42V/49S/134C/355A/401V, 42V/134C/186G, 42V/186G/355A, 46V/49Q/134T, 49S/134C/355A, 105A/143P/232T/237V/373R/416R/422R/441R, 105A/143P/278L/373R, 105A/189S/237V, 105A/237L/278L/373R/416R/422R, 105A/237L/373R/422R/441R, 105A/373R, 105A/373R/441R, 134C/401V, 143P, 143P/1895, 143P/189/232T/422R/441R, 143P/189/237L/373R/416R/422R, 143P/232T, 143P/237L/422R/441R, 143P/237V, 186G/355A, 189/232T/373R/416R/422R/441R, 1895/237L/278I/416R/441R, 232T/237L, 237L/422R, 237V/373R, and 237V/373R/441R, wherein the positions are numbered with reference to SEQ ID NO: 3696. In some embodiments, the polypeptide sequence of the engineered glycosyltransferase comprises at least one mutation or mutation set at one or more positions selected from H2-/H5N/Q35D/S105A/K143P/P237V/K373R/K416R/K422R, H2-/H5N/Q35D/K143P/P232T/P237L/K416R/K422R/Q441R, H2-/H5N/Q35D/P232T/V278L/K373R/K416R, H2-/H5N/S105A/K143P/P232T/K373R/K416R/K422R, H2-/H5N/V278L, H2-/S105A/K143P/P232T/P237L/V278L/K373R/Q441R, H2-/K143P/P232T/K373R/Q441R, H2-/K143P/K373R/Q441R, H5N/Q35D/P232T/K373R/K416R/K422R, H5N/S105A/P232T/P237L/K373R/K416R/Q441R, H5N/S105A/P237L/V278I/K422R/Q441R, H5N/S105A/P237V/K416R/K422R/Q441R, H5N/K143P/P189S/P232T/P237V/Q441R, H5N/K143P/P232T/P237L/V278L, H5N/K143P/P232T/P237L/K416R/K422R, H5N/K143P/P232T/K373R/K422R/Q441R, H5N/K143P/P237L/V278L/K373R/K416R/K422R, H5N/K143P/K373R, H5N/P189S/P237V/V278I/K373R/K416R/K422R/Q441R, H5N/P232T/K416R/K422R, H5N/P237L/K373R/K422R, H5N/K373R/K416R, I26V/L42I/L49Q/V134C/E186G/F355A, I26V/L42I/L49Q/V134C/L401V, I26V/L42V, I26V/L42V/C46V/L49A, I26V/L42V/C46V/L49A/V134A, I26V/L42V/C46V/L49A/V134C/E186G, I26V/L42V/C46V/V134A, I26V/L42V/L49S/V134C, I26V/L42V/V134C/L401V, I26V/L49Q/V134A, I26V/V134A, I26V/V134A/E186G/F355A/L401V, I26V/V134C/F355A, I26V/V134T/L401V, I26V/F355A/L401V, Q35D, Q35D/S105A/P189S/P232T/K373R/K416R, L42I/C46V/L49A/V134A, L42I/C46V/L49S/V134C/E186G, L42I/C46V/L49S/E186G, L42V/C46V/L49A/V134A/L401V, L42V/C46V/L49A/V134T/E186G/F355A, L42V/C46V/L49P/V134C/Q235R/F355A/L401V, L42V/C46V/L49S/T97P/V134C/L401V, L42V/L49A/V134C/E186G/F355A, L42V/L49S/V134A/E186G/L401V, L42V/L49S/V134C/F355A/L401V, L42V/V134C/E186G, L42V/E186G/F355A, C46V/L49Q/V134T, L49S/V134C/F355A, S105A/K143P/P232T/P237V/K373R/K416R/K422R/Q441R, S105A/K143P/V278L/K373R, S105A/P189S/P237V, S105A/P237L/V278L/K373R/K416R/K422R, S105A/P237L/K373R/K422R/Q441R, S105A/K373R, S105A/K373R/Q441R, V134C/L401V, K143P, K143P/P189S, K143P/P189S/P232T/K422R/Q441R, K143P/P189S/P237L/K373R/K416R/K422R, K143P/P232T, K143P/P237L/K422R/Q441R, K143P/P237V, E186G/F355A, P189S/P232T/K373R/K416R/K422R/Q441R, P189S/P237L/V278I/K416R/Q441R, P232T/P237L, P237L/K422R, P237V/K373R, and P237V/K373R/Q441R, wherein the positions are numbered with reference to SEQ ID NO: 3696. In some embodiments, the polypeptide sequence of the engineered glycosyltransferase comprises at least one mutation or mutation set at one or more positions selected from 3, 8, 50, 61, 62, 101, 137, 158, 161, 164, 176, 193, 223, 223/243, 235, 237, 239, 240, 243, 244, 248, 249, 301, 323, 330, 352, 364, 426, and 427, wherein the positions are numbered with reference to SEQ ID NO: 3696. In some embodiments, the polypeptide sequence of the engineered glycosyltransferase comprises at least one mutation or mutation set at one or more positions selected from 3N, 8R, 8V, 50P, 50V, 61N, 61Y, 62A, 101L, 137R, 158W, 161L, 164A, 164E, 164F, 164L, 176P, 176Q, 176T, 193F, 223A, 223L/243G, 235R, 237A, 237L, 239F, 239G, 239M, 239P, 239Q, 239Y, 240V, 243G, 243H, 243R, 243S, 243Y, 244N, 248T, 249G, 249H, 301A, 323T, 330C, 352A, 364Q, 426L, 427S, and 427T, wherein the positions are numbered with reference to SEQ ID NO: 3696. In some embodiments, the polypeptide sequence of the engineered glycosyltransferase comprises at least one mutation or mutation set at one or more positions selected from H3N, S8R, S8V, I50P, I50V, E61N, E61Y, K62A, A101L, Q137R, F158W, R161L, H164A, H164E, H164F, H164L, R176P, R176Q, R176T, D193F, T223A, T223L/D243G, Q235R, P237A, P237L, T239F, T239G, T239M, T239P, T239Q, T239Y, E240V, D243G, D243H, D243R, D243S, D243Y, D244N, I248T, D249G, D249H, Q301A, D323T, H330C, S352A, M364Q, A426L, R427S, and R427T, wherein the positions are numbered with reference to SEQ ID NO: 3696. In some embodiments, the polypeptide sequence of the engineered glycosyltransferase comprises a sequence at least 90% identical to any of SEQ ID NOS: 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120, 4122, 4124, 4126, 4128, 4130, 4132, 4134, 4136, 4138, 4140, 4142, 4144, and 4146. In some embodiments, the polypeptide sequence of the engineered glycosyltransferase comprises a sequence at least 95% identical to any of SEQ ID NOS: 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120, 4122, 4124, 4126, 4128, 4130, 4132, 4134, 4136, 4138, 4140, 4142, 4144, and 4146. In some embodiments, the polypeptide sequence of the engineered glycosyltransferase comprises any of SEQ ID NOS: 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120, 4122, 4124, 4126, 4128, 4130, 4132, 4134, 4136, 4138, 4140, 4142, 4144, and 4146.

The present invention also provides engineered glycosyltransferases, wherein the polypeptide sequence of the engineered glycosyltransferases comprise at least one mutation or mutation set at one or more positions selected from 5/73/113/186/187/373/423, 5/73/143/144/179/186/187/422, 5/73/144/179/186/373/423, 5/73/144/187/373/422, 5/143/144/179/181/186/187/373, 5/144/179/181/373/422, 5/144/373/422, 49/96/127/132/156/196, 49/96/127/153/278, 49/96/132/153/155/156/237/278/406, 49/96/132/153/199/200, 49/96/132/155, 49/96/132/155/237/278, 49/96/155/199/200/406, 49/153/155, 73/113/143/179/181/422, 73/113/179/181/186/187, 73/143/144/179/186/187/373/423, 73/179/181/186/187/373, 73/179/181/186/373/422, 73/181/186/187, 96/127/132/153/278, 96/127/153/155, 96/132/153/155, 96/132/153/155/156, 96/132/153/155/156/200, 96/132/153/156, 96/132/196/199, 96/132/278, 96/153/155/156, 96/153/155/199/200/237, 96/153/406, 113/143/179/186/187, 113/144/186/423, 113/144/373, 113/181/186/373/422, 113/373/422, 127/132, 127/132/153/156, 127/132/155/156/406, 127/153/155/199/200/237, 127/406, 132/153/155, 132/153/237/406, 132/155, 132/237, 143/144/179/181/186/187/422, 143/179/181/186/187/422/423, 144/179/181/186/187/373, 144/179/186/187/373, 153/155/156/237, 153/155/196/199/237, 153/199/406, 153/237, 155/199, 179/181/186, 179/181/186/187/423, 179/186/187, 179/187/373/422, 181/186/187/422/423, and 373/423, wherein the positions are numbered with reference to SEQ ID NO: 3956. In some embodiments, the polypeptide sequence of the engineered glycosyltransferase comprises at least one mutation or mutation set at one or more positions selected from 5N/73A/113I/186G/187R/373R/423R, 5N/73A/143P/144V/179D/186G/187R/422R, 5N/73A/144V/179D/186A/373R/423R, 5N/73A/144V/187R/373R/422R, 5N/143P/144V/179T/181L/186G/187R/373R, 5N/144V/179T/181L/373R/422R, 5N/144V/373R/422R, 49S/96A/127I/132K/156W/196S, 49S/96A/132H/153A/199S/200S, 49S/96P/127I/153A/278L, 49S/96P/132H/153A/155M/156W/237L/278L/406Q, 49S/96P/132H/155M, 49S/96P/132K/155M/237L/278L, 49S/96P/155M/199S/200S/406Q, 49S/153A/155M, 73A/113I/143P/179T/181L/422R, 73A/113I/179T/181L/186A/187R, 73A/143P/144V/179D/186G/187T/373R/423R, 73A/179D/181L/186A/373R/422R, 73A/179D/181L/186G/187R/373R, 73A/181L/186A/187T, 96A/132H/153A/156W, 96A/132K/153A/155M/156W, 96A/132K/153A/155M/156W/200S, 96A/153A/155M/156W, 96P/127I/132H/153A/278L, 96P/127I/153A/155M, 96P/132H/153A/155M/156W, 96P/132H/196S/199S, 96P/132K/153A/155M, 96P/132K/278L, 96P/153A/155M/199S/200S/237L, 96P/153A/406Q, 113I/143P/179T/179D/186G/187R, 113I/144V/186G/423R, 113I/144V/373R, 113I/181L/186A/373R/422R, 113I/373R/422R, 127I/132H, 127I/132H/153A/156W, 127I/132H/155M/156W/406Q, 127I/153A/155M/199S/200S/237L, 127I/406Q, 132H/153A/237L/406Q, 132H/155M, 132K/153A/155M, 132K/237L, 143P/144V/179T/181L/186G/187R/422R, 143P/179T/181L/186G/187R/422R/423R, 144V/179T/181L/186A/187R/373R, 144V/179T/186A/187T/373R, 153A/155M/156W/237L, 153A/155M/196S/199S/237L, 153A/155M/196S/199S/237L, 153A/199S/406Q, 153A/237L, 155M/199S, 179D/181L/186G/187R/423R, 179D/187T/373R/422R, 179T/181L/186A, 179T/186A/187T, 181L/186G/187R/422R/423R, and 373R/423R, wherein the positions are numbered with reference to SEQ ID NO: 3956. In some embodiments, the polypeptide sequence of the engineered glycosyltransferase comprises at least one mutation or mutation set at one or more positions selected from H5N/P73A/L113I/E186G/K187R/K373R/N423R, H5N/P73A/K143P/I144V/V179D/E186G/K187R/K422R, H5N/P73A/I144V/V179D/E186A/K373R/N423R, H5N/P73A/I144V/K187R/K373R/K422R, H5N/K143P/I144V/V179T/M181L/E186G/K187R/K373R, H5N/I144V/V179T/M181L/K373R/K422R, H5N/I144V/K373R/K422R, A49S/G96A/Q127I/Q132K/F156W/A196S, A49S/G96A/Q132H/S153A/N199S/A200S, A49S/G96P/Q127I/S153A/V278L, A49S/G96P/Q132H/S153A/F155M/F156W/P237L/V278L/T406Q, A49S/G96P/Q132H/F155M, A49S/G96P/Q132K/F155M/P237L/V278L, A49S/G96P/F155M/N199S/A200S/T406Q, A49S/S153A/F155M, P73A/L113I/K143P/V179T/M181L/K422R, P73A/L113I/V179T/M181L/E186A/K187R, P73A/K143P/I144V/V179D/E186G/K187T/K373R/N423R, P73A/V179D/M181L/E186A/K373R/K422R, P73A/V179D/M181L/E186G/K187R/K373R, P73A/M181L/E186A/K187T, G96A/Q132H/S153A/F156W, G96A/Q132K/S153A/F155M/F156W, G96A/Q132K/S153A/F155M/F156W/A200S, G96A/S153A/F155M/F156W, G96P/Q127I/Q132H/S153A/V278L, G96P/Q127I/S153A/F155M, G96P/Q132H/S153A/F155M/F156W, G96P/Q132H/A196S/N199S, G96P/Q132K/S153A/F155M, G96P/Q132K/V278L, G96P/S153A/F155M/N199S/A200S/P237L, G96P/S153A/T406Q, L113I/K143P/V179D/E186G/K187R, L113I/I144V/E186G/N423R, L113I/I144V/K373R, L113I/M181L/E186A/K373R/K422R, L113I/K373R/K422R, Q127I/Q132H, Q127I/Q132H/S153A/F156W, Q127I/Q132H/F155M/F156W/T406Q, Q127I/S153A/F155M/N199S/A200S/P237L, Q127I/T406Q, Q132H/S153A/P237L/T406Q, Q132H/F155M, Q132K/S153A/F155M, Q132K/P237L, K143P/I144V/V179T/M181L/E186G/K187R/K422R, K143P/V179T/M181L/E186G/K187R/K422R/N423R, I144V/V179T/M181L/E186A/K187R/K373R, I144V/V179T/E186A/K187T/K373R, S153A/F155M/F156W/P237L, S153A/F155M/A196S/N199S/P237L, S153A/N199S/T406Q, S153A/P237L, F155M/N199S, V179D/M181L/E186G/K187R/N423R, V179D/K187T/K373R/K422R, V179T/M181L/E186A, V179T/E186A/K187T, M181L/E186G/K187R/K422R/N423R, and K373R/N423R, wherein the positions are numbered with reference to SEQ ID NO: 3956. In some embodiments, the polypeptide sequence of the engineered glycosyltransferase comprises at least one mutation or mutation set at one or more positions selected from 11, 12, 41, 44, 44/187, 45, 55, 56, 57, 65, 66, 70, 72, 73, 74/238, 82, 83, 85, 103, 111, 113, 114, 117, 132, 135, 138, 140, 159, 160, 162, 167, 182, 214, 220, 222, 223, 226, 236, 238, 256, 286, 299, 309, 387, 388, 389, 391, 393, 406, 408, 412, 418, 422, 429, 430, 449, and 450, wherein the positions are numbered with reference to SEQ ID NO: 3956. In some embodiments, the polypeptide sequence of the engineered glycosyltransferase comprises at least one mutation or mutation set at one or more positions selected from 11D, 11L, 12, 12L, 41H, 44H, 44S/187T, 45Y, 55A, 55G, 55L, 56R, 57G, 57H, 57P, 65C, 65G, 65P, 65Q, 65R, 66L, 70W, 72V, 73H, 73S, 74M/238V, 82S, 83R, 85W, 103H, 103Q, 111F, 113S, 114G, 114I, 117N, 117S, 132G, 135E, 138K, 138S, 138T, 140C, 140G, 159N, 160D, 160Q, 160T, 162L, 167L, 182I, 182L, 182Q, 182T, 182V, 182Y, 214H, 214T, 220G, 220S, 222F, 223D, 226Q, 236L, 236T, 236V, 238A, 238G, 238I, 238R, 238S, 238T, 256R, 286G, 299V, 309P, 309R, 309S, 309T, 387P, 387Q, 387R, 388A, 388S, 389A, 389G, 389L, 389V, 391A, 391L, 391S, 391V, 393P, 393T, 406G, 406S, 408L, 408T, 412G, 412R, 418A, 418H, 418M, 422L, 429D, 430P, 449G, 449H, 449L, 449R, 449S, 450N, and 450V, wherein the positions are numbered with reference to SEQ ID NO: 3956. In some embodiments, the polypeptide sequence of the engineered glycosyltransferase comprises at least one mutation or mutation set at one or more positions selected from Q11D, Q11L, T12I, T12L, F41H, Y44H, Y44S/K187T, L45Y, I55A, I55G, I55L, K56R, K57G, K57H, K57P, N65C, N65G, N65P, N65Q, N65R, S66L, V70W, L72V, P73H, P73S, L74M/M238V, P82S, H83R, H85W, K103H, K103Q, K111F, L113S, Q114G, Q114I, K117N, K117S, Q132G, L135E, G138K, G138S, G138T, P140C, P140G, L159N, K160D, K160Q, K160T, P162L, P167L, R182I, R182L, R182Q, R182T, R182V, R182Y, K214H, K214T, T220G, T220S, L222F, T223D, K226Q, D236L, D236T, D236V, M238A, M238G, M238I, M238R, M238S, M238T, E256R, N286G, E299V, K309P, K309R, K309S, K309T, D387P, D387Q, D387R, E388A, E388S, D389A, D389G, D389L, D389V, R391A, R391L, R391S, R391V, H393P, H393T, T406G, T406S, P408L, P408T, I412G, I412R, R418A, R418H, R418M, K422L, E429D, E430P, Y449G, Y449H, Y449L, Y449R, Y449S, K450N, and K450V, wherein the positions are numbered with reference to SEQ ID NO: 3956. In some embodiments, the polypeptide sequence of the engineered glycosyltransferase comprises a sequence at least 90% identical to any of SEQ ID NOS: 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212, 4214, 4216, 4218, 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460, 4462, 4464, 4466, 4468, 4470, 4472, 4474, 4476, 4478, 4480, 4482, 4484, 4486, 4488, 4490, 4492, 4494, and 4496. In some embodiments, the polypeptide sequence of the engineered glycosyltransferase comprises a sequence at least 95% identical to any of SEQ ID NOS: 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212, 4214, 4216, 4218, 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460, 4462, 4464, 4466, 4468, 4470, 4472, 4474, 4476, 4478, 4480, 4482, 4484, 4486, 4488, 4490, 4492, 4494, and 4496. In some embodiments, the polypeptide sequence of the engineered glycosyltransferase comprises any of SEQ ID NOS: 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212, 4214, 4216, 4218, 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460, 4462, 4464, 4466, 4468, 4470, 4472, 4474, 4476, 4478, 4480, 4482, 4484, 4486, 4488, 4490, 4492, 4494, and 4496.

The present invention also provides engineered glycosyltransferases, wherein the polypeptide sequence of the engineered glycosyltransferases comprise at least one mutation or mutation set at one or more positions selected from 8/375, 50/137/189/375, 62/153/155/156/159, 62/153/155/156/159/427, 62/153/155/199/406, 137/164/375, 153, 153/155/156, 153/155/156/159/199/238/406, 153/155/237/238/239/406, 153/155/238/239, 153/155/427, 153/156/159, 153/156/199/237/427, 153/156/427, 153/159/237/238/352, 153/176/181/427, 155/156, 155/156/176/181/199, 155/156/176/238/427, 155/181/199/238/406, 156/199, 156/199/427, 164/375/433, 223/375, 375, and 427, wherein the positions are numbered with reference to SEQ ID NO: 4256. In some embodiments, the polypeptide sequence of the engineered glycosyltransferase comprises at least one mutation or mutation set at one or more positions selected from 8V/375L, 50V/137R/189G/375L, 62A/153A/155M/156W/159V, 62A/153A/155M/156W/159V/427T, 62A/153A/155M/199S/406Q, 137R/164E/375L, 153A, 153A/155M/156W, 153A/155M/156W/159V/199S/238G/406Q, 153A/155M/237L/238T/239F/406Q, 153A/155M/238T/239F, 153A/155M/427T, 153A/156W/159V, 153A/156W/199S/237L/427T, 153A/156W/427T, 153A/159V/237L/238G/352A, 153A/176Q/181L/427S, 155M/156W, 155M/156W/176Q/181L/199S, 155M/156W/176Q/238T/427S, 155M/181L/199S/238G/406Q, 156W/199S, 156W/199S/427T, 164E/375L/433D, 223A/375L, 375L, and 427S, wherein the positions are numbered with reference to SEQ ID NO: 4256. In some embodiments, the polypeptide sequence of the engineered glycosyltransferase comprises at least one mutation or mutation set at one or more positions selected from S8V/I375L, 150V/Q137R/P189G/I375L, K62A/S153A/F155M/F156W/L159V, K62A/S153A/F155M/F156W/L159V/R427T, K62A/S153A/F155M/N199S/T406Q, Q137R/H164E/I375L, S153A, S153A/F155M/F156W, S153A/F155M/F156W/L159V/N199S/M238G/T406Q, S153A/F155M/P237L/

M238T/T239F/T406Q, S153A/F155M/M238T/T239F, S153A/F155M/R427T, S153A/F156W/L159V, S153A/F156W/N199S/P237L/R427T, S153A/F156W/R427T, S153A/L159V/P237L/M238G/S352A, S153A/R176Q/M181L/R427S, F155M/F156W, F155M/F156W/R176Q/M181L/N199S, F155M/F156W/R176Q/M238T/R427S, F155M/M181L/N199S/M238G/T406Q, F156W/N199S, F156W/N199S/R427T, H164E/I375L/N433D, T223A/I375L, I375L, and R427S, wherein the positions are numbered with reference to SEQ ID NO: 4256. In some embodiments, the polypeptide sequence of the engineered glycosyltransferase comprises at least one mutation or mutation set at one or more positions selected from 7, 9, 10, 12, 53, 65, 68, 99, 106, 110, 115, 116, 131, 132, 136, 170, 178, 190, 192, 194, 200, 220, 238, 242, 245, 257, 272, 280, 302, 304, 335, 385, 395, 399, 402, 408, 412, 416, 423, 445, 447, and 449, wherein the positions are numbered with reference to SEQ ID NO: 4256. In some embodiments, the polypeptide sequence of the engineered glycosyltransferase comprises at least one mutation or mutation set at one or more positions selected from 7H, 9G, 10D, 12S, 53N, 65F, 68I, 99R, 106K, 106R, 106S, 110G, 115A, 115T, 116I, 131C, 131S, 132G, 132R, 132T, 136D, 136G, 136R, 136S, 170E, 178L, 190T, 192A, 192L, 192P, 194F, 200S, 220M, 220Q, 220S, 238I, 238L, 242L, 245P, 257H, 272H, 280W, 302P, 302S, 304I, 335K, 335R, 385A, 385C, 385P, 385S, 395Q, 399K, 402R, 408E, 412R, 416R, 423L, 445H, 445K, 445R, 447L, 449K, 449L, 449Q, and 449R, wherein the positions are numbered with reference to SEQ ID NO: 4256. In some embodiments, the polypeptide sequence of the engineered glycosyltransferase comprises at least one mutation or mutation set at one or more positions selected from G7H, S9G, G10D, T12S, E53N, N65F, H68I, H99R, A106K, A106R, A106S, S110G, N115A, N115T, L116I, E131C, E131S, Q132G, Q132R, Q132T, E136D, E136G, E136R, E136S, A170E, Q178L, D190T, E192A, E192L, E192P, P194F, A200S, T220M, T220Q, T220S, M238I, M238L, I242L, K245P, N257H, R272H, F280W, N302P, N302S, E304I, P335K, P335R, V385A, V385C, V385P, V385S, G395Q, Q399K, K402R, P408E, I412R, K416R, R423L, N445H, N445K, N445R, N447L, Y449K, Y449L, Y449Q, and Y449R, wherein the positions are numbered with reference to SEQ ID NO: 4256. In some embodiments, the polypeptide sequence of the engineered glycosyltransferase comprises a sequence at least 90% identical to any of SEQ ID NOS: 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4640, 4642, 4644, 4646, 4648, 4650, 4652, 4654, 4656, 4658, 4660, 4662, 4664, 46664668, 4670, 4672, 4674, 4676, 4678, 4680, and 4682. In some embodiments, the polypeptide sequence of the engineered glycosyltransferase comprises a sequence at least 95% identical to any of SEQ ID NOS: 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4640, 4642, 4644, 4646, 4648, 4650, 4652, 4654, 4656, 4658, 4660, 4662, 4664, 4666 4668, 4670, 4672, 4674, 4676, 4678, 4680, and 4682. In some embodiments, the polypeptide sequence of the engineered glycosyltransferase comprises any of SEQ ID NOS: 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4640, 4642, 4644, 4646, 4648, 4650, 4652, 4654, 4656, 4658, 4660, 4662, 4664, 46664668, 4670, 4672, 4674, 4676, 4678, 4680, and 4682.

The present invention also provides engineered glycosyltransferases, wherein the polypeptide sequence of the engineered glycosyltransferases comprise at least one mutation or mutation set at one or more positions selected from 11/41/44/127/132/406, 11/41/44/127/278/406, 11/41/45/73/127/278/406/408, 11/41/45/127/278/406, 11/41/132/278, 11/44/45/127, 11/44/73/127/132/135, 11/44/73/127/132/135/406/408, 11/44/127, 11/44/132/278/406, 11/45/73/127/135, 11/45/127/132/135/138/182, 11/45/406, 11/73/127/132/135/182/278, 11/73/127/132/278/406/408, 11/73/127/132/406/408, 11/73/132, 11/73/132/135/408, 11/127/132/135, 11/127/132/135/182, 11/127/132/135/406, 11/127/132/138/182, 11/127/132/182, 11/132/135/406, 11/182/406, 41/44/45/73/127/132/278, 41/45/127/132/135/278/406, 41/73/132/135/406, 44/45/73/132/135/406, 44/45/127/132/135/138/182/406/408, 44/45/127/132/278, 44/73/127/135, 44/73/127/135/182/278/406/408, 44/73/132/135/406/408, 45/73/127/132/135/406/408, 45/73/132, 45/73/132/135/182, 45/73/278/406/408, 45/127/132, 45/127/132/135/182, 45/127/132/135/182/406/408, 45/127/135, 45/132/408, 45/406, 56/309/449, 57, 65/114/422/427, 65/114/427, 65/143, 65/143/235/427, 73/127, 73/127/132, 127, 127/132/135/182, 127/132/135/182/406, 132/135, 132/135/182, 132/135/406, 132/406, 164, 164/220/309/449, 164/220/449, 164/449, 182, 220/449, 309, 309/449, 406, 418/427, 427, 427/429, and 449, wherein the positions are numbered with reference to SEQ ID NO: 4550. In some embodiments, the polypeptide sequence of the engineered glycosyltransferase comprises at least one mutation or mutation set at one or more positions selected from 11L/41H/44H/127I/132K/406G, 11L/41H/44H/127I/278L/406S, 11L/41H/45Y/73H/127I/278L/406G/408A, 11L/41H/45Y/127I/278L/406G, 11L/41H/132K/278L, 11L/44H/45Y/127I, 11L/44H/73H/127I/132K/135E, 11L/44H/73S/127I/132K/135E/406G/408A, 11L/44H/127I, 11L/44H/132K/278L/406G, 11L/45Y/73H/127I/135E, 11L/45Y/127I/132K/135E/138T/182T, 11L/45Y/406G, 11L/73H/127I/132K/278L/406G/408A, 11L/73H/127I/132K/406G/408A, 11L/73H/132K, 11L/73S/127I/132K/135E/182L/278L, 11L/73S/132K/135E/408A, 11L/127I/132K/135E, 11L/127I/132K/135E/182L, 11L/127I/132K/135E/406S, 11L/127I/132K/138T/182L, 11L/127I/132K/182T, 11L/132K/135E/406G, 11L/182L/406S, 41H/44H/45Y/73H/127I/132K/278L, 41H/45Y/127I/132K/135E/278L/406S, 41H/73H/132K/135E/406G, 44H/45Y/73H/132K/135E/406G, 44H/45Y/127I132K/135E/138T/182L/406S/408A, 44H/45Y/127I/132K/278L, 44H/73H/127I/135E, 44H/73S/127I/135E/182L/278L/406G/408A, 44H/73S/132K/135E/406G/408A, 45Y/73H/127I/132K/135E/406G/408A, 45Y/73H/132K, 45Y/73H/132K/135E/182L, 45Y/73S/278L/406G/408A, 45Y/127I/132K, 45Y/127I/132K/135E/182L, 45Y/127I/132K/135E/182T/406G/408A, 45Y/127I/135E, 45Y/132K/408A, 45Y/406G, 56R/309P/449L, 57G, 65G/114I/422L/

427S, 65G/114I/427S, 65G/143K, 65G/143K/235R/427S, 73H/127I, 73H/127I/132K, 127I, 127I/132K/135E/182I/ 406G, 127I/132K/135E/182L, 132K/135E, 132K/135E/ 182I, 132K/135E/406G, 132K/406S, 164E, 164E/220G/ 309S/449H, 164E/220G/449L, 164E/449H, 182L, 220G/ 449H, 309P/449L, 309R, 309T/449H, 406G, 418A/427S, 427S, 427S/429D, and 449L, wherein the positions are numbered with reference to SEQ ID NO: 4550. In some embodiments, the polypeptide sequence of the engineered glycosyltransferase comprises at least one mutation or mutation set at one or more positions selected from Q11L/F41H/ Y44H/Q127I/Q132K/T406G, Q11L/F41H/Y44H/Q127I/ V278L/T406S, Q11L/F41H/L45Y/A73H/Q127I/V278L/ T406G/P408A, Q11L/F41H/L45Y/Q127I/V278L/T406G, Q11L/F41H/Q132K/V278L, Q11L/Y44H/L45Y/Q127I, Q11L/Y44H/A73H/Q127I/Q132K/L135E, Q11L/Y44H/ A73S/Q127I/Q132K/L135E/T406G/P408A, Q11L/Y44H/ Q127I, Q11L/Y44H/Q132K/V278L/T406G, Q11L/L45Y/ A73H/Q127I/L135E, Q11L/L45Y/Q127I/Q132K/L135E/ G138T/R182T, Q11L/L45Y/T406G, Q11/A73H/Q127I/ Q132K/V278L/T406G/P408A, Q11L/A73H/Q27I/Q132K/ T406G/P408A, Q11L/A73H/Q132K, Q11L/A73S/Q127I/ Q132K/L135E/R182L/V278L, Q11L/A73S/Q132K/L135E/ P408A, Q11L/Q127I/Q132K/L135E, Q11L/Q127I/Q132K/ L135E/R182L, Q11L/Q127I/Q132K/L135E/T406S, Q11L/ Q127I/Q132K/G138T/R182L, Q11L/Q127I/Q132K/R182T, Q11L/Q132K/L135E/T406G, Q11L/R182L/T406S, F41H/ Y44H/L45Y/A73H/Q127I/Q132K/V278L, F41H/L45Y/ Q127I/Q132K/L135E/V278L/T406S, F41H/A73H/Q132K/ L135E/T406G, Y44H/L45Y/A73H/Q132K/L135E/T406G, Y44H/L45Y/Q127I/Q132K/L135E/G138T/R182L/T406S/ P408A, Y44H/L45Y/Q127I/Q132K/V278L, Y44H/A73H/ Q127I/L135E, Y44H/A73S/Q127I/L135E/R182L/V278L/ T406G/P408A, Y44H/A73S/Q132K/L135E/T406G/P408A, L45Y/A73H/Q127I/Q132K/L135E/T406G/P408A, L45Y/ A73H/Q132K, L45Y/A73H/Q132K/L135E/R182L, L45Y/ A73S/V278L/T406G/P408A, L45Y/Q127I/Q132K, L45Y/ Q127I/Q132K/L135E/R182L, L45Y/Q127I/Q132K/L135E/ R182T/T406G/P408A, L45Y/Q127I/L135E, L45Y/Q132K/ P408A, L45Y/T406G, K56R/K309P/Y449L, K57G, N65G/ Q114I/K422L/R427S, N65G/Q14I/R427S, N65G/P143K, N65G/P143K/Q235R/R427S, A73H/Q127I, A73H/Q127I/ Q132K, Q127I, Q127I/Q132K/L135E/R182I/T406G, Q127I/Q132K/L135E/R182L, Q132K/L135E, Q132K/ L135E/R182I, Q132K/L135E/T406G, Q132K/T406S, H164E, H164E/T220G/K309S/Y449H, H164E/T220G/ Y449L, H164E/Y449H, R182L, T220G/Y449H, K309P/ Y449L, K309R, K309T/Y449H, T406G, R418A/R427S, R427S, R427S/E429D, and Y449L, wherein the positions are numbered with reference to SEQ ID NO: 4550. In some embodiments, the polypeptide sequence of the engineered glycosyltransferase comprises a sequence at least 90% identical to any of SEQ ID NOS: 7216, 7218, 7220, 7222, 7224, 7226, 7228, 7230, 7232, 7234, 7236, 7238, 7240, 7242, 7244, 7246, 7248, 7250, 7252, 7254, 7256, 7258, 7260, 7262, 7264, 7266, 7268, 7270, 7272, 7274, 7276, 7278, 7280, 7282, 7284, 7286, 7288, 7290, 7292, 7294, 7296, 7298, 7300, 7302, 7304, 7306, 7308, 7310, 7312, 7314, 7316, 7318, 7320, 7322, 7324, 7326, 7328, 7330, 7332, 7334, 7336, 7338, 7340, 7342, 7344, 7346, 7348, 7350, 7352, 7354, 7356, 7358, and 7360. In some embodiments, the polypeptide sequence of the engineered glycosyltransferase comprises a sequence at least 95% identical to any of SEQ ID NOS: 7216, 7218, 7220, 7222, 7224, 7226, 7228, 7230, 7232, 7234, 7236, 7238, 7240, 7242, 7244, 7246, 7248, 7250, 7252, 7254, 7256, 7258, 7260, 7262, 7264, 7266, 7268, 7270, 7272, 7274, 7276, 7278, 7280, 7282, 7284, 7286, 7288, 7290, 7292, 7294, 7296, 7298, 7300, 7302, 7304, 7306, 7308, 7310, 7312, 7314, 7316, 7318, 7320, 7322, 7324, 7326, 7328, 7330, 7332, 7334, 7336, 7338, 7340, 7342, 7344, 7346, 7348, 7350, 7352, 7354, 7356, 7358, and 7360. In some embodiments, the polypeptide sequence of the engineered glycosyltransferase comprises any of SEQ ID NOS: 7216, 7218, 7220, 7222, 7224, 7226, 7228, 7230, 7232, 7234, 7236, 7238, 7240, 7242, 7244, 7246, 7248, 7250, 7252, 7254, 7256, 7258, 7260, 7262, 7264, 7266, 7268, 7270, 7272, 7274, 7276, 7278, 7280, 7282, 7284, 7286, 7288, 7290, 7292, 7294, 7296, 7298, 7300, 7302, 7304, 7306, 7308, 7310, 7312, 7314, 7316, 7318, 7320, 7322, 7324, 7326, 7328, 7330, 7332, 7334, 7336, 7338, 7340, 7342, 7344, 7346, 7348, 7350, 7352, 7354, 7356, 7358, and 7360.

The present invention also provides engineered glycosyltransferases, wherein the polypeptide sequence of the engineered glycosyltransferases comprise at least one mutation or mutation set at one or more positions selected from 7/10/73/127/132/385/423, 10, 10/53/73/99, 10/53/272/423/ 427, 10/53/423, 10/73, 10/73/127, 10/127/132/385, 10/132/ 302/385, 53/73/200/423, 53/127/132/385, 53/127/136/385, 53/132/136/302/423/427, 53/132/302/385/423/427, 65/106/ 445/447/449, 65/143/220, 65/220/309/445/447, 65/220/445/ 449, 65/399/406/447/449, 65/402/406/445/449, 65/445/447/ 449, 65/447/449, 73, 73/127/427, 73/132/136/385/427, 73/385, 73/385/427, 106/220/399/402/406, 115/116/278, 115/170/190/238/412, 115/190/194, 115/245/278, 116/170/ 190, 116/190/406/408, 116/238, 116/238/245, 116/416, 127, 132, 143/220/445/447, 143/309/402, 143/309/445/447/449, 170, 170/190/192/194, 170/192, 170/192/194/278, 170/192/ 194/335, 170/194, 170/194/335/416, 170/238, 170/335, 170/ 335/416, 190, 190/192/194, 190/194, 190/194/238/245, 190/ 194/335/416, 190/194/412, 190/245/412, 192/194, 192/194/ 242/406/408, 194, 200, 200/385, 220/399, 220/445, 220/ 445/447, 257/385, 272/302, 272/385, 278, 302/385, 309/ 399/449, 309/445/447/449, 385, 385/427, 399/406, 399/406/ 449, 402/445/449, 406/445/447/449, 406/445/449, 423/427, 445/447/449, 445/449, 447, and 449, wherein the positions are numbered with reference to SEQ ID NO: 7324. In some embodiments, the polypeptide sequence of the engineered glycosyltransferase comprises at least one mutation or mutation set at one or more positions selected from 7V/10D/73H/ 127I/132G/385P/423L, 10D, 10D/53N/73H/99R, 10D/53N/ 272H/423L/427S, 10D/53N/423L, 10D/73H, 10D/73H/ 127I, 10D/127I/132R/385P, 10D/132R/302P/385P, 53N/ 73H/200S/423L, 53N/127I/132R/385S, 53N/127I/136R/ 385L, 53N/132G/136R/302P/423L/427S, 53N/132G/302P/ 385S/423L/427S, 65G/106R/445K/447L/449L, 65G/143K/ 220Q, 65G/220Q/309P/445R/447L, 65G/220Q/445R/449K, 65G/220Q/445R/449R, 65G/399K/406G/447L/449R, 65G/ 402R/406G/445R/449R, 65G/445K/447L/449R, 65G/447L/ 449L, 73H, 73H/127I/427S, 73H/132R/136R/385S/427S, 73H/385S, 73H/385S/427S, 106R/220Q/399K/402R/406G, 115A/170E/190T/238L/412R, 115A/190T/194F, 115A/ 245P/278L, 115T/116I/278L, 116I/170E/190T, 116I/190T/ 406G/408A, 116I/238L, 116I/238L/245P, 116I/416R, 127I, 132G, 143K/220Q/445K/447L, 143K/309P/402R, 143K/ 309P/445K/447L/449L, 170E, 170E/190T/192L/194F, 170E/192L, 170E/192L/194F/278L, 170E/192L/194F/ 335K, 170E/194F, 170E/194F/335R/416R, 170E/238L, 170E/335K, 170E/335K/416R, 190T, 190T/192L/194F, 190T/194F, 190T/194F/238L/245P, 190T/194F/335R/416R, 190T/194F/412R, 190T/245P/412R, 192L/194F, 192L/ 194F/242L/406G/408A, 194F, 200S, 200S/385S, 220M/ 445K, 220Q/399K, 220Q/445K/447L, 257H/385S, 272H/ 302P, 272H/385P, 278L, 302P/385P, 302P/385S, 309P/

399K/449L, 309P/445K/447L/449L, 385S, 385S/427S, 399K/406G, 399K/406G/449L, 402R/445R/449L, 406G/445K/449R, 406G/445R/447L/449L, 406G/445R/449K, 423L/427S, 445K/449L, 445R/447L/449L, 445R/449L, 447L, and 449L, wherein the positions are numbered with reference to SEQ ID NO: 7324. In some embodiments, the polypeptide sequence of the engineered glycosyltransferase comprises at least one mutation or mutation set at one or more positions selected from G7V/G10D/A73H/Q127I/K132G/V385P/R423L, G10D, G10D/E53N/A73H/H99R, G10D/E53N/R272H/R423L/R427S, G10D/E53N/R423L, G10D/A73H, G10D/A73H/Q127I, G10D/Q127I/K132R/V385P, G10D/K132R/N302P/V385P, E53N/A73H/A200S/R423L, E53N/Q127I/K132R/V385S, E53N/Q127I/E136R/V385L, E53N/K132G/E136R/N302P/R423L/R427S, E53N/K132G/N302P/V385S/R423L/R427S, N65G/A106R/N445K/N447L/Y449L, N65G/P143K/T220Q, N65G/T220Q/K309P/N445R/N447L, N65G/T220Q/N445R/Y449K, N65G/T220Q/N445R/Y449R, N65G/Q399K/S406G/N447L/Y449R, N65G/K402R/S406G/N445R/Y449R, N65G/N445K/N447L/Y449R, N65G/N447L/Y449L, A73H, A73H/Q127I/R427S, A73H/K132R/E136R/V385S/R427S, A73H/V385S, A73H/V385S/R427S, A106R/T220Q/Q399K/K402R/S406G, N115A/A170E/D190T/M238L/I412R, N115A/D190T/P194F, N115A/K245P/V278L, N115T/L116I/V278L, L16I/A170E/D190T, L116I/D190T/S406G/P408A, L116I/M238L, L116I/M238L/K245P, L116I/K416R, Q127I, K132G, P143K/T220Q/N445K/N447L, P143K/K309P/K402R, P143K/K309P/N445K/N447L/Y449L, A170E, A170E/D190T/E192L/P194F, A170E/E192L, A170E/E192L/P194F/V278L, A170E/E192L/P194F/P335K, A170E/P194F, A170E/P194F/P335R/K416R, A170E/M238L, A170E/P335K, A170E/P335K/K416R, D190T, D190T/E192L/P194F, D190T/P194F, D190T/P194F/M238L/K245P, D190T/P194F/P335R/K416R, D190T/P194F/I412R, D190T/K245P/I412R, E192L/P194F, E192L/P194F/I242L/S406G/P408A, P194F, A200S, A200S/V385S, T220M/N445K, T220Q/Q399K, T220Q/N445K/N447L, N257H/V385S, R272H/N302P, R272H/V385P, V278L, N302P/V385P, N302P/V385S, K309P/Q399K/Y449L, K309P/N445K/N447L/Y449L, V385S, V385S/R427S, Q399K/S406G, Q399K/S406G/Y449L, K402R/N445R/Y449L, S406G/N445K/Y449R, S406G/N445R/N447L/Y449L, S406G/N445R/Y449K, R423L/R427S, N445K/Y449L, N445R/N447L/Y449L, N445R/Y449L, N447L, and Y449L, wherein the positions are numbered with reference to SEQ ID NO: 7324. In some embodiments, the polypeptide sequence of the engineered glycosyltransferase comprises at least one mutation or mutation set at one or more positions selected from 2, 4, 11/44, 11/71, 11/287, 11/441, 37, 40, 42, 42/138, 42/141, 43, 46, 47, 48/398, 49, 49/406/408, 51, 64, 71, 76, 97, 100, 108, 108/172, 109, 112, 117/157/301, 118, 118/406/408, 119, 119/172, 130, 133, 134, 141, 157, 169, 172/420, 172/437, 179, 181, 259, 274, 275, 287, 288, 333/398, 333/406/408, 338, 356, 357, 376, 381, 385, 394/420, 396, 397/406/408, 398, 401, 406/408, 410, 417, 420, 434, 437, and 441, wherein the positions are numbered with reference to SEQ ID NO: 7324. In some embodiments, the polypeptide sequence of the engineered glycosyltransferase comprises at least one mutation or mutation set at one or more positions selected from 2T, 4F, 11L/44H, 11L/71P, 11L/71T, 11L/287S, 11L/441S, 37G, 40Q, 42A, 42A/141P, 42D/138C, 42G, 43A, 43L, 43M, 43T, 46C, 46L, 46Q, 46T, 47N, 48S/398V, 49G, 49K, 49N/406/408A, 51M, 51Q, 51V, 64A, 64F, 64G, 64L, 64Q, 64R, 64V, 71T, 76H, 76L, 97L, 97V, 100R, 108G/172H, 108T, 109L, 109V, 109Y, 112N, 112Q, 112R, 112T, 112V, 117R/157T/301R, 118A, 118A/406G/408A, 118I, 118L, 118S, 118V, 119A, 119G, 119S, 119T/172H, 130S, 133H, 133L, 133R, 133S, 134S, 141G, 141Q, 141S, 157C, 157E, 157T, 169E, 172H/420L, 172H/437D, 179I, 179R, 181H, 181T, 259T, 274Q, 274T, 275L, 287A, 287K, 287L, 287S, 288P, 333S/398T, 333S/406G/408A, 338S, 356S, 356T, 357T, 376G, 376M, 376N, 376R, 376S, 381C, 385A, 394H/420W, 396A, 396S, 397L/406G/408A, 398H, 398K, 398L, 398M, 398R, 401T, 406G/408A, 410R, 417C, 417S, 420F, 420L, 434C, 437G, 437V, and 441L, wherein the positions are numbered with reference to SEQ ID NO: 7324. In some embodiments, the polypeptide sequence of the engineered glycosyltransferase comprises at least one mutation or mutation set at one or more positions selected from H2T, H4F, Q11L/Y44H, Q11L/E71P, Q11L/E71T, Q11L/V287S, Q11L/Q441S, A37G, G40Q, V42A, V42A/A141P, V42D/G138C, V42G, I43A, I43L, I43M, I43T, V46C, V46L, V46Q, V46T, S47N, T48S/A398V, A49G, A49K, A49N/S406G/P408A, N51M, N51Q, N51V, S64A, S64F, S64G, S64L, S64Q, S64R, S64V, E71T, E76H, E76L, T97L, T97V, K100R, N108G/R172H, N108T, F109L, F109V, F109Y, I112N, I112Q, I112R, I112T, I112V, K117R/N157T/Q301R, P118A, P118A/S406G/P408A, P118I, P118L, P118S, P118V, D119A, D119G, D119S, D119T/R172H, A130S, V133H, V133L, V133R, V133S, A134S, A141G, A141Q, A141S, N157C, N157E, N157T, P169E, R172H/I420L, R172H/E437D, D179I, D179R, M181H, M181T, V259T, D274Q, D274T, M275L, V287A, V287K, V287L, V287S, N288P, N333S/A398T, N333S/S406G/P408A, G338S, G356S, G356T, V357T, V376G, V376M, V376N, V376R, V376S, A381C, V385A, R394H/I420W, E396A, E396S, I397L/S406G/P408A, A398H, A398K, A398L, A398M, A398R, L401T, S406G/P408A, G410R, V417C, V417S, I420F, I420L, A434C, E437G, E437V, and Q441L, wherein the positions are numbered with reference to SEQ ID NO: 7324. In some embodiments, the polypeptide sequence of the engineered glycosyltransferase comprises a sequence at least 90% identical to any of SEQ ID NOS: 7766, 7768, 7770, 7772, 7774, 7776, 7778, 7780, 7782, 7784, 7786, 7788, 7790, 7792, 7794, 7796, 7798, 7800, 7812, 7814, 7816, 7818, 7820, 7822, 7824, 7826, 7828, 7830, 7832, 7834, 7836, 7838, 7840, 7842, 7844, 7846, 7848, 7850, 7852, 7854, 7856, 7858, 7860, 7862, 7864, 7866, 7868, 7870, 7872, 7874, 7876, 7878, 7880, 7882, 7884, 7886, 7888, 7890, 7892, 7894, 7896, 7898, 7900, 7902, 7904, 7906, 7908, 7910, 7912, 7914, 7916, 7918, 7920, 7922, 7924, 7926, 7928, 7930, 7932, 7934, 7936, 7938, 7940, 7942, 7944, 8092, 8094, 8096, 8098, 8100, 8102, 8104, 8106, 8108, 8110, 8112, 8114, 8116, 8118, 8120, 8122, 8124, 8126, 8128, 8130, 8132, 8134, 8136, 8138, 8140, 8142, 8144, 8146, 8148, 8150, 8152, 8154, 8156, 8158, 8160, 8162, 8164, 8166, 8168, 8170, 8172, 8174, 8176, 8178, 8180, 8182, 8184, 8186, 8188, 8190, 8192, 8194, 8196, 8198, 8200, 8202, 8204, 8206, 8208, 8210, 8212, 8214, 8216, 8218, 8220, 8222, 8224, 8226, 8228, 8230, 8232, 8234, 8236, 8238, 8240, 8242, 8244, 8246, 8248, 8250, 8252, 8254, 8256, 8258, 8260, 8262, 8264, 8266, 8268, 8270, 8272, 8274, 8276, 8278, 8280, 8282, 8284, 8286, 8288, 8290, 8292, 8294, 8296, 8298, 8300, 8302, 8304, 8306, 8308, 8310, 8312, 8314, 8316, 8318, 8320, 8322, 8324, 8326, 8328, 8330, 8332, 8334, 8336, and 8338. In some embodiments, the polypeptide sequence of the engineered glycosyltransferase comprises a sequence at least 95% identical to any of SEQ ID NOS: 7766, 7768, 7770, 7772, 7774, 7776, 7778, 7780, 7782, 7784, 7786, 7788, 7790, 7792, 7794, 7796, 7798, 7800, 7812, 7814, 7816, 7818, 7820, 7822, 7824, 7826, 7828, 7830, 7832, 7834, 7836, 7838, 7840, 7842, 7844, 7846, 7848, 7850, 7852, 7854, 7856, 7858, 7860, 7862, 7864, 7866, 7868, 7870, 7872, 7874, 7876, 7878, 7880, 7882, 7884, 7886, 7888, 7890, 7892, 7894, 7896, 7898, 7900, 7902, 7904, 7906, 7908, 7910, 7912, 7914, 7916, 7918, 7920, 7922, 7924, 7926, 7928, 7930, 7932, 7934, 7936, 7938, 7940, 7942, 7944, 8092, 8094, 8096, 8098, 8100, 8102, 8104, 8106, 8108, 8110, 8112, 8114, 8116, 8118, 8120, 8122, 8124, 8126, 8128, 8130, 8132, 8134, 8136, 8138, 8140, 8142, 8144, 8146, 8148, 8150, 8152, 8154, 8156, 8158, 8160, 8162, 8164, 8166, 8168, 8170, 8172, 8174, 8176, 8178, 8180, 8182, 8184, 8186, 8188, 8190, 8192, 8194, 8196, 8198, 8200, 8202, 8204, 8206, 8208, 8210, 8212, 8214, 8216, 8218, 8220, 8222, 8224, 8226, 8228, 8230, 8232, 8234, 8236, 8238, 8240, 8242, 8244, 8246, 8248, 8250, 8252, 8254, 8256, 8258, 8260, 8262, 8264, 8266, 8268, 8270, 8272, 8274, 8276, 8278, 8280, 8282, 8284, 8286, 8288, 8290, 8292, 8294, 8296, 8298, 8300, 8302, 8304, 8306, 8308, 8310, 8312, 8314, 8316, 8318, 8320, 8322, 8324, 8326, 8328, 8330, 8332, 8334, 8336, and 8338. In some embodiments, the polypeptide sequence of the engineered glycosyltransferase comprises any of SEQ ID NOS: 7766, 7768, 7770, 7772, 7774, 7776, 7778, 7780, 7782, 7784, 7786, 7788, 7790, 7792, 7794, 7796, 7798, 7800, 7812, 7814, 7816, 7818, 7820, 7822, 7824, 7826, 7828, 7830, 7832, 7834, 7836, 7838, 7840, 7842, 7844, 7846, 7848, 7850, 7852, 7854, 7856, 7858, 7860, 7862, 7864, 7866, 7868, 7870, 7872, 7874, 7876, 7878, 7880, 7882, 7884, 7886, 7888, 7890, 7892, 7894, 7896, 7898, 7900, 7902, 7904, 7906, 7908, 7910, 7912, 7914, 7916, 7918, 7920, 7922, 7924, 7926, 7928, 7930, 7932, 7934, 7936, 7938, 7940, 7942, 7944, 8092, 8094, 8096, 8098, 8100, 8102, 8104, 8106, 8108, 8110, 8112, 8114, 8116, 8118, 8120, 8122, 8124, 8126, 8128, 8130, 8132, 8134, 8136, 8138, 8140, 8142, 8144, 8146, 8148, 8150, 8152, 8154, 8156, 8158, 8160, 8162, 8164, 8166, 8168, 8170, 8172, 8174, 8176, 8178, 8180, 8182, 8184, 8186, 8188, 8190, 8192, 8194, 8196, 8198, 8200, 8202, 8204, 8206, 8208, 8210, 8212, 8214, 8216, 8218, 8220, 8222, 8224, 8226, 8228, 8230, 8232, 8234, 8236, 8238, 8240, 8242, 8244, 8246, 8248, 8250, 8252, 8254, 8256, 8258, 8260, 8262, 8264, 8266, 8268, 8270, 8272, 8274, 8276, 8278, 8280, 8282, 8284, 8286, 8288, 8290, 8292, 8294, 8296, 8298, 8300, 8302, 8304, 8306, 8308, 8310, 8312, 8314, 8316, 8318, 8320, 8322, 8324, 8326, 8328, 8330, 8332, 8334, 8336, and 8338.

The present invention also provides engineered glycosyltransferases, wherein the polypeptide sequence of the engineered glycosyltransferases comprise at least one mutation or mutation set at one or more positions selected from 11, 11/64/109, 11/445, 42/43, 42/44/71/73/116, 43/73/141, 46/47/51, 46/51, 47/49, 47/51, 64, 64/65/109, 64/65/112, 64/112, 64/134, 64/445, 65/112, 65/112/445, 71, 71/73, 71/73/141, 71/141, 71/302, 73, 73/116/141, 73/141, 73/302, 109, 109/112, 109/115/118, 109/134, 109/406, 112, 112/445, 116/287, 127, 127/169/172, 127/169/287, 127/169/376/398/ 399, 127/169/398/399, 127/287, 127/376, 141, 141/302, 169/172/287, 169/172/288, 169/172/288/398/399/420/423/ 427, 169/172/398/399, 169/287, 169/398, 169/398/399, 287, 287/288, 287/376, 287/398, 287/399, 287/420/423/427, 288, 288/376/398, 288/398, 288/399, 302, 376, 376/398, 376/ 399, 398, 398/399, 398/399/420, 398/427, 399, and 420, wherein the positions are numbered with reference to SEQ ID NO: 7784. In some embodiments, the polypeptide sequence of the engineered glycosyltransferase comprises at least one mutation or mutation set at one or more positions selected from 11L, 11L/64R/109V, 11L/445K, 42A/44H/ 71T/73H/116I, 42G/43M, 43T/73H/141P, 46L/47N/51Q, 46T/51Q, 47N/49G, 47N/51V, 64R, 64R/65G/109V, 64R/ 65G/112N, 64R/65G/112T, 64R/112N, 64R/134S, 64R/ 445K, 65G/112N, 65G/112N/445K, 71T, 71T/73H, 71T/ 73H/141G, 71T/73H/141S, 71T/141P, 71T/302P, 73H, 73H/ 116I/141P, 73H/141G, 73H/141P, 73H/141S, 73H/302P, 109L/112T, 109V, 109V/112T, 109V/115A/118V, 109V/ 134S, 109V/406G, 112N/445K, 112T, 116I/287S, 127I, 127I/169E/172H, 127I/169E/287S, 127I/169E/376M/ 398M/399K, 127I/169E/398L/399K, 127I/287S, 127I/ 376M, 141G, 141G/302P, 141P, 141S, 141S/302P, 169E/ 172H/287S, 169E/172H/288P, 169E/172H/288P/398L/ 399K/420F/423L/427S, 169E/172H/398M/399K, 169E/ 287S, 169E/398M/399K, 169E/398T, 287L/288P, 287L/ 399K, 287M, 287S, 287S/376M, 287S/398T, 2875/399K, 287S/420F/423L/427S, 288P, 288P/376S/398L, 288P/398K, 288P/399K, 302P, 376M, 376M/398L, 376M/398M, 376M/ 399K, 398L, 398L/399K, 398L/427S, 398M, 398M/399K, 398M/399K/420F, 398R, 398R/399K, 398T/399K, 399K, and 420F, wherein the positions are numbered with reference to SEQ ID NO: 7784. In some embodiments, the polypeptide sequence of the engineered glycosyltransferase comprises at least one mutation or mutation set at one or more positions selected from Q11L, Q11L/S64R/F109V, Q11L/N445K, V42A/Y44H/E71T/A73H/L116I, V42G/ I43M, I43T/A73H/A141P, V46L/S47N/N51Q, V46T/ N51Q, S47N/A49G, S47N/N51V, S64R, S64R/N65G/ F109V, S64R/N65G/I112N, S64R/N65G/I112T, S64R/ I112N, S64R/A134S, S64R/N445K, N65G/I112N, N65G/ I112N/N445K, E71T, E71T/A73H, E71T/A73H/A141G, E71T/A73H/A141S, E71T/A141P, E71T/N302P, A73H, A73H/L116I/A141P, A73H/A141G, A73H/A141P, A73H/ A141S, A73H/N302P, F109L/I112T, F109V, F109V/I112T, F109V/N115A/P118V, F109V/A134S, F109V/S406G, I112N/N445K, I112T, L116I/V287S, Q127I, Q127I/P169E/ R172H, Q127I/P169E/V287S, Q127I/P169E/V376M/ A398M/Q399K, Q127I/P169E/A398L/Q399K, Q127I/ V287S, Q127I/V376M, A141G, A141G/N302P, A141P, A141S, A141S/N302P, P169E/R172H/V287S, P169E/ R172H/N288P, P169E/R172H/N288P/A398L/Q399K/ I420F/R423L/R427S, P169E/R172H/A398M/Q399K, P169E/V287S, P169E/A398M/Q399K, P169E/A398T, V287L/N288P, V287L/Q399K, V287M, V287S, V287S/ V376M, V287S/A398T, V287S/Q399K, V287S/I420F/ R423L/R427S, N288P, N288P/V376S/A398L, N288P/ A398K, N288P/Q399K, N302P, V376M, V376M/A398L, V376M/A398M, V376M/Q399K, A398L, A398L/Q399K, A398L/R427S, A398M, A398M/Q399K, A398M/Q399K/ I420F, A398R, A398R/Q399K, A398T/Q399K, Q399K, and I420F, wherein the positions are numbered with reference to SEQ ID NO: 7784. In some embodiments, the polypeptide sequence of the engineered glycosyltransferase comprises at least one mutation or mutation set at one or more positions selected from 10, 10/144, 10/199, 13, 14, 15, 15/394, 16, 22, 36, 89, 93, 96, 116, 116/123, 116/143, 116/350, 123, 125, 127, 143, 144, 149, 156, 186, 187, 197, 198, 199, 201, 202, 203, 268, 287, 324, 331, and 350, wherein the positions are numbered with reference to SEQ ID NO: 7784. In some embodiments, the polypeptide sequence of the engineered glycosyltransferase comprises at least one mutation or mutation set at one or more positions selected from 10D, 10D/ 144L, 10D/199G, 13Q, 14Q, 15A, 15L/394H, 16A, 16G, 16T, 22G, 36M, 89A, 93A, 96M, 116I, 116I/123N, 116I/ 123S, 116I/143R, 116I/350L, 123A, 123G, 123L, 123S, 123V, 125L, 127A, 127G, 127V, 143G, 144G, 144Q, 144S, 149S, 156V, 186N, 187G, 187Y, 197H, 198Q, 199G, 199P, 199R, 199S, 199Y, 201A, 201K, 201L, 201N, 202A, 202Y, 203T, 268W, 287A, 324R, 331C, 331V, and 350L, wherein the positions are numbered with reference to SEQ ID NO: 7784. In some embodiments, the polypeptide sequence of the engineered glycosyltransferase comprises at least one mutation or mutation set at one or more positions selected from G10D, G10D/V144L, G10D/N199G, L13Q, R14Q, V15A, V15L/R394H, L16A, L16G, L16T, A22G, L36M, G89A, H93A, G96M, L116I, L116I/Y123N, L116I/Y123S, L116I/P143R, L116I/M350L, Y123A, Y123G, Y123L, Y123S, Y123V, F125L, Q127A, Q127G, Q127V, P143G, V144G, V144Q, V144S, A149S, F156V, G186N, T187G, T187Y, P197H, G198Q, N199G, N199P, N199R, N199S, N199Y, G201A, G201K, G201L, G201N, I202A, I202Y, M203T, Y268W, V287A, H324R, I331C, I331V, and M350L, wherein the positions are numbered with reference to SEQ ID NO: 7784. In some embodiments, the polypeptide sequence of the engineered glycosyltransferase comprises a sequence at least 90% identical to any of SEQ ID NOS: 8624, 8626, 8628, 8630, 8632, 8634, 8636, 8638, 8640, 8642, 8644, 8646, 8648, 8650, 8652, 8654, 8656, 8658, 8660, 8662, 8664, 8666, 8668, 8670, 8672, 8674, 8676, 8678, 8680, 8682, 8684, 8686, 8688, 8690, 8692, 8694, 8696, 8698, 8700, 8702, 8704, 8706, 8708, 8710, 8712, 8714, 8716, 8718, 8720, 8722, 8724, 8726, 8728, 8730, 8732, 8734, 8736, 8738, 8740, 8742, 8744, 8746, 8748, 8750, 8752, 8754, 8756, 8758, 8760, 8762, 8764, 8766, 8768, 8770, 8772, 8774, 8776, 8778, 8780, 8782, 8784, 8786, 8788, 8790, 8792, 8794, 8796, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, and 9222. In some embodiments, the polypeptide sequence of the engineered glycosyltransferase comprises a sequence at least 95% identical to any of SEQ ID NOS: 8624, 8626, 8628, 8630, 8632, 8634, 8636, 8638, 8640, 8642, 8644, 8646, 8648, 8650, 8652, 8654, 8656, 8658, 8660, 8662, 8664, 8666, 8668, 8670, 8672, 8674, 8676, 8678, 8680, 8682, 8684, 8686, 8688, 8690, 8692, 8694, 8696, 8698, 8700, 8702, 8704, 8706, 8708, 8710, 8712, 8714, 8716, 8718, 8720, 8722, 8724, 8726, 8728, 8730, 8732, 8734, 8736, 8738, 8740, 8742, 8744, 8746, 8748, 8750, 8752, 8754, 8756, 8758, 8760, 8762, 8764, 8766, 8768, 8770, 8772, 8774, 8776, 8778, 8780, 8782, 8784, 8786, 8788, 8790, 8792, 8794, 8796, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, and 9222. In some embodiments, the polypeptide sequence of the engineered glycosyltransferase comprises any of SEQ ID NOS: 8624, 8626, 8628, 8630, 8632, 8634, 8636, 8638, 8640, 8642, 8644, 8646, 8648, 8650, 8652, 8654, 8656, 8658, 8660, 8662, 8664, 8666, 8668, 8670, 8672, 8674, 8676, 8678, 8680, 8682, 8684, 8686, 8688, 8690, 8692, 8694, 8696, 8698, 8700, 8702, 8704, 8706, 8708, 8710, 8712, 8714, 8716, 8718, 8720, 8722, 8724, 8726, 8728, 8730, 8732, 8734, 8736, 8738, 8740, 8742, 8744, 8746, 8748, 8750, 8752, 8754, 8756, 8758, 8760, 8762, 8764, 8766, 8768, 8770, 8772, 8774, 8776, 8778, 8780, 8782, 8784, 8786, 8788, 8790, 8792, 8794, 8796, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, and 9222.

The present invention also provides engineered sucrose synthase comprising a polypeptide sequence that is at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO:72. In some embodiments the present invention provides engineered sucrose synthase comprising a polypeptide sequence that is at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 90% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 91% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 92% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 93% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 94% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 95% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 96% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 97% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 98% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence that is at least 99% or more sequence identity to SEQ ID NO: 74, 1080, 1158, 1222, 1392, 1456, 1582, 1764, 1804, 1840, 2064, 2432, 2510, 7506, and/or 8420. In some embodiments the present invention provides engineered sucrose synthase comprising a polypeptide sequence of SEQ ID NO: 74, 1080, 1158, 1222, 1392, 1456, 1582, 1764, 1804, 1840, 2064, 2432, 2510, 7506, and/or 8420. In additional embodiments, the present invention provides sucrose synthases provided in Table 18.1, 19.1, 19.2, 20.1, 20.2, 20.3, 31.2, 31.3, 32.1, 32.2, 33.1, 33.2, 34.1, 34.2, 35.1, 35.2, 36.1, 36.2, 37.1, 37.2, 37.3, 38.1, 38.2, 38.3, 39.1, 39.2, 39.3, 40.1, 40.2, 40.3, 41.1, 41.2, 42.1, and/or 42.2. The present invention also provides engineered sucrose synthase comprising a polypeptide sequence that has at least 90%, 91%, 92%, 93%, 94%, 95%, 96%, 97%, 98%, 99%, or more sequence identity to SEQ ID NO: 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, 2594, 7438, 7440, 7442, 7444, 7446, 7448, 7450, 7452, 7454, 7456, 7458, 7460, 7462, 7464, 7466, 7468, 7470, 7472, 7474, 7476, 7478, 7480, 7482, 7484, 7486, 7488, 7490, 7492, 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558, 7560, 7562, 7564, 7566, 7568, 7570, 7572, 7574, 7576, 7578, 7580, 7582, 7584, 7586, 7588, 7590, 7592, 7594, 7596, 7598, 7600, 7602, 7604, 7606, 7608, 7610, 7612, 7614, 7616, 7618, 7620, 7622, 7624, 7626, 7628, 7630, 7632, 7634, 7636, 7638, 7640, 7642, 7644, 7646, 7648, 7650, 7652, 7654, 7656, 7658, 7660, 7662, 7664, 7666, 7668, 7670, 7672, 7674, 7676, 7678, 7680, 7682, 7684, 7686, 7688, 7690, 7692, 7694, 7696, 7698, 7700, 7702, 7704, 7706, 7708, 7710, 7712, 7714, 7716, 7718, 7720, 7722, 7724, 7726, 7728, 7730, 7732, 7734, 7736, 7738, 7740, 7742, 7744, 7746, 7748, 7750, 7752, 7754, 7756, 7758, 7760, 7762, 7764, 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442, 8444, 8446, 8448, 8450, 8452, 8454, 8456, 8458, 8460, 8462, 8464, 8466, 8468, 8470, 8472, 8474, 8476, 8478, 8480, 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, and/or 9106.

The present invention also provides engineered sucrose synthases, wherein the polypeptide sequence of the engineered sucrose synthases comprise at least one mutation or mutation set at one or more positions selected from 4/9/349/ 532, 4/13/113/343/532, 4/13/113/532, 4/33/47/52/343/532, 4/47/52/532, 4/113/532, 4/13/113, 4/13/532, 4/33/113, 4/343, 7, 8, 44, 95, 117/440, 136, 221, 343/532, 440, 444, 478, 532, 583, 611, 615, 615/789, 695, 722, and 788, wherein the positions are numbered with reference to SEQ ID NO:74. In some embodiments, the polypeptide sequence of the engineered sucrose synthase comprises at least one mutation or mutation set at one or more positions selected from 4E/9T/349H/532S, 4E/13R/113Q/343H/532S, 4E/13R/113Q/532S, 4E/33Q/47H/52D/343H/532S, 4E/47H/52D/532S, 4E/113Q/532S, 4E/13R/113Q, 4E/13R/ 532S, 4E/33Q/113Q, 4E/343H, 7T, 8M, 44K, 95S, 117D/ 440T, 136S, 221A/H, 343S/532S, 440P/T, 444K/T, 478T/V, 532R/T, 583Q, 611V, 615C/E/T/V, 615L/789D, 695L, 722Y, and 788E, wherein the positions are numbered with reference to SEQ ID NO:74. In some embodiments, the polypeptide sequence of the engineered sucrose synthase comprises at least one mutation or mutation set at one or more positions selected from A4E/L9T/Q349H/F532S, A4E/ P13R/I113Q/V343H/F532S, A4E/P13R/I113Q/F532S, A4E/Y33Q/L47H/A52D/V343H/F532S, A4E/L47H/A52D/ F532S, A4E/I113Q/F532S, A4E/P13R/I113Q, A4E/P13R/ F532S, A4E/Y33Q/I113Q, A4E/V343H, Q7T, Q8M, R44K, Q95S, G117D/R440T, R136S, R221A/H, V343S/F532S, R440P/T, Q444K/T, R478T/V, F532R/T, R583Q, R611V, R615C/E/T/V, R615L/A789D, V695L, R722Y, and H788E, wherein the positions are numbered with reference to SEQ ID NO:74. In some embodiments, the polypeptide sequence of the engineered sucrose synthase comprises a sequence at least 90% identical to any of SEQ ID NOS: 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, and/or 1152. In some embodiments, the polypeptide sequence of the engineered sucrose synthase comprises a sequence at least 95% identical to any of SEQ ID NOS: 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, and/or 1152. In some further embodiments, the polypeptide sequence of the engineered sucrose synthase comprises any of SEQ ID NOS: 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, and/or 1152.

The present invention also provides engineered sucrose synthases, wherein the polypeptide sequence of the engineered sucrose synthases comprise at least one mutation or mutation set at one or more positions selected from 8/221, 47/221, 68/129/248, 68/129/248/595/600/756, 68/146/248/ 387/506/550, 68/189/272/316/477/719/756, 75/105/154/ 215/264/345, 75/105/345/410/769, 75/105/530, 75/345/530, 85/170/225/266/534, 87/125/230/267/375/464/708, 93/129/ 506/550/595/719/756, 93/477/635, 95/136/788, 95/201/478/ 583/724/788, 95/385/478/583/788, 95/440/478/724/788/ 792, 95/444/478/603/792, 95/444/478/724/788, 95/478/724, 98/250, 113/225/266/415, 126/314/499/549/589/755, 136/ 440/444/478/603, 136/440/444/478/583/788, 136/444/478/ 583/788/792, 225/372/534, 266, 306/358/703/776, 358/636/ 737, 440/444/583/724/788, 440/478, and 466, wherein the positions are numbered with reference to SEQ ID NO:1080. In some embodiments, the polypeptide sequence of the engineered sucrose synthase comprises at least one mutation or mutation set at one or more positions selected from 8M/221H, 47L/221H, 68A/129E/248A, 68A/129E/248A/ 595V/600I/756V, 68A/146N/248A/387I/506P/550H, 68A/ 189R/272L/316I/477K/719C/756V, 75V/105E/154H/215F/ 264V/345T, 75V/105E/345T/410S/769R, 75V/105E/530L, 75V/345T/530L, 85V/170L/225E/266N/534H, 87E/125E/ 230D/267V/375Y/464F/708A, 93V/129E/506P/550H/ 595V/719C/756V, 93V/477K/635S, 95S/136S/788E, 95S/ 201E/478V/583Q/724H/788E, 95S/385L/478V/583Q/ 788E, 95S/440T/478V/724H/788E/792S, 95S/444T/478V/ 603S/792S, 95S/444T/478V/724H/788E, 95S/478T/724H, 98V/250D, 113L/225E/266N/415K, 126L/314L/499H/ 549E/589E/755G, 136S/440P/444T/478T/603S, 136S/ 440T/444T/478V/583Q/788E, 136S/444T/478V/583Q/ 788E/792S, 225E/372V/534H, 266N, 306L/358E/703Y/ 776E, 358E/636Q/737I, 440P/444T/583Q/724H/788E, 440T/478V, and 466, wherein the positions are numbered with reference to SEQ ID NO:1080. In some embodiments, the polypeptide sequence of the engineered sucrose synthase comprises at least one mutation or mutation set at one or more positions selected from Q8M/R221H, H47L/R221H, V68A/R129E/S248A, V68A/R129E/S248A/I595V/V600I/ I756V, V68A/D146N/S248A/V387I/S506P/R550H, V68A/ G189R/I272L/V316I/D477K/A719C/I756V, M75V/A105E/ R154H/I215F/I264V/A345T, M75V/A105E/A345T/T410S/ Q769R, M75V/A105E/P530L, M75V/A345T/P530L, R85V/I170L/A225E/R266N/E534H, I87E/T125E/N230D/ I267V/W375Y/I464F/T708A, R93V/R129E/S506P/ R550H/I595V/A719C/I756V, R93V/D477K/A635S, Q95S/ R136S/H788E, Q95S/Q201E/R478V/R583Q/K724H/ H788E, Q95S/R385L/R478V/R583Q/H788E, Q95S/ R440T/R478V/K724H/H788E/M792S, Q95S/Q444T/ R478V/G603S/M792S, Q95S/Q444T/R478V/K724H/ H788E, Q95S/R478T/K724H, L98V/S250D, I113L/A225E/ R266N/R415K, V126L/V314L/N499H/D549E/G589E/ R755G, R136S/R440P/Q444T/R478T/G603S, R136S/ R440T/Q444T/R478V/R583Q/H788E, R136S/Q444T/ R478V/R583Q/H788E/M792S, A225E/I372V/E534H, R266N, R306L/P358E/N703Y/Q776E, P358E/L636Q/ V737I, R440P/Q444T/R583Q/K724H/H788E, R440T/ R478V, and V466I, wherein the positions are numbered with reference to SEQ ID NO: 1080.

In some embodiments, the polypeptide sequence of the engineered sucrose synthase comprises a sequence at least 90% identical to any of SEQ ID NOS: 1192, 1194, 1196, 1198, 1200, 1202, 1204, 1206, 1208, 1210, 1212, 1214, 1216, 1218, and/or 1220. In some embodiments, the polypeptide sequence of the engineered sucrose synthase comprises a sequence at least 95% identical to any of SEQ ID NOS: 1192, 1194, 1196, 1198, 1200, 1202, 1204, 1206, 1208, 1210, 1212, 1214, 1216, 1218, and/or 1220. In some embodiments, the polypeptide sequence of the engineered sucrose synthase comprises any of SEQ ID NOS: 1192, 1194, 1196, 1198, 1200, 1202, 1204, 1206, 1208, 1210, 1212, 1214, 1216, 1218, and/or 1220.

The present invention also provides engineered sucrose synthases, wherein the polypeptide sequence of the engineered sucrose synthases comprise at least one mutation or mutation set at one or more positions selected from 8/68/ 95/98/358/478/595/724/792, 8/68/98/221/248/250/440/477/ 534/595/724, 8/68/788, 8/93/95/98/136/221/595/600/788, 8/93/95/113/250/440/595/600/724/788, 8/95/98/440/478/

534/600/788, 8/136/248/478/788, 47/75/85/105/125/129/ 170/635, 47/75/85/105/375/756/776, 47/75/85/264/267/ 372/415/635, 47/75/85/87/129/375/776, 47/75/85/87/170/ 372/756, 47/85/105/129/201/230/267/583, 47/85/125/372/ 583/635/756, 47/85/170/756, 47/85/87/105/125/635, 47/85/ 87/154/756, 47/125/129/375/756/776, 47/129/170/635, 47/154/372/375/583/635/708/756, 68/93/95/358/440/444/ 478/534/595/603, 68/93/95/444/788, 68/93/98/136/248/ 250/358/440/534/724, 75/85/87/105/264/267/583/708, 75/85/129/154/264/375, 85/125/215/375/415/635/776, 85/87/105/215/267/756, 85/87/129/375/756/776, 87/125/ 129/170/230/756, 87/154/306/375/756, 93/95/98/534/792, 95/440/444/724/788, 129/215/372/756, and 170/264/267, wherein the positions are numbered with reference to SEQ ID NO:1158. In some embodiments, the polypeptide sequence of the engineered sucrose synthase comprises at least one mutation or mutation set at one or more positions selected from 8M/68A/95S/98V/358E/478T/595V/724H/ 792S, 8M/68A/98V/221H/248A/250D/440P/477K/534H/ 595V/724H, 8M/68A/788E, 8M/93V/95S/98V/136S/221H/ 595V/600I/788E, 8M/93V/95S/113I/250D/440T/595V/ 600I/724H/788E, 8M/95S/98V/440P/478V/534H/600I/ 788E, 8M/136S/248A/478V/788E, 47L/75V/85V/105E/ 125E/129E/170L/635S, 47L/75V/85V/105E/375Y/756V/ 776E, 47L/75V/85V/264V/267V/372V/415R/635S, H47L/ M75V/R85V/I87E/R129E/W375Y/Q776E, 47L/75V/85V/ 87E/170L/372V/756V, 47L/85V/105E/129E/201E/230D/ 267V/583Q, 47L/85V/125E/372V/583Q/635S/756V, 47L/ 85V/170L/756V, 47L/85V/87E/105E/125E/635S, 47L/85V/ 87E/154H/756V, 47L/125E/129E/375Y/756V/776E, 47L/ 129E/170L/635S, 47L/154H/372V/375Y/583Q/635S/ 708A/756V, 68A/93V/95S/358E/440T/444T/478V/534H/ 595V/603S, 68A/93V/95S/444T/788E, 68A/93V/98V/ 136S/248A/250D/358E/440P/534H/724H, 75V/85V/87E/ 105E/264V/267V/583Q/708A, 75V/85V/129E/154H/264V/ 375Y, 85V/125E/215F/375Y/415R/635S/776E, 85V/87E/ 105E/215F/267V/756V, 85V/87E/129E/375Y/756V/776E, 87E/125E/129E/170L/230D/756V, 87E/154H/306L/375Y/ 756V, 93V/95S/98V/534H/792S, 95S/440P/444T/724H/ 788E, 129E/215F/372V/756V, 170L/264V/267V, 8M/68A/ 95S/98V/358E/478T/595V/724H/792S, 8M/68A/98V/ 221H/248A/250D/440P/477K/534H/595V/724H, 8M/68A/ 788E, 8M/93V/95S/98V/136S/221H/595V/600I/788E, 8M/93V/95S/113I/250D/440T/595V/600I/724H/788E, 8M/95S/98V/440P/478V/534H/600I/788E, 8M/136S/ 248A/478V/788E, 47L/75V/85V/105E/125E/129E/170L/ 635S, 47L/75V/85V/105E/375Y/756V/776E, 47L/75V/ 85V/264V/267V/372V/415R/635S, 47L/75V/85V/87E/ 129E/375Y/776E, 47L/75V/85V/87E/170L/372V/756V, 47L/85V/105E/129E/201E/230D/267V/583Q, 47L/85V/ 125E/372V/583Q/635S/756V, 47L/85V/170L/756V, 47L/ 85V/87E/105E/125E/635S, 47L/85V/87E/154H/756V, 47L/ 125E/129E/375Y/756V/776E, 47L/129E/170L/635S, 47L/ 154H/372V/375Y/583Q/635S/708A/756V, 68A/93V/95S/ 358E/440T/444T/478V/534H/595V/603S, 68A/93V/95S/ 444T/788E, 68A/93V/98V/136S/248A/250D/358E/440P/ 534H/724H, 75V/85V/87E/105E/264V/267V/583Q/708A, 75V/85V/129E/154H/264V/375Y, 85V/125E/215F/375Y/ 415R/635S/776E, 85V/87E/105E/215F/267V/756V, 85V/ 87E/129E/375Y/756V/776E, 87E/125E/129E/170L/230D/ 756V, 87E/154H/306L/375Y/756V, 93V/95S/98V/534H/ 792S, 95S/440P/444T/724H/788E, 129E/215F/372V/756V, and 170L/264V/267V, wherein the positions are numbered with reference to SEQ ID NO:1158. In some further embodiments, the polypeptide sequence of the engineered sucrose synthase comprises at least one mutation or mutation set at one or more positions selected from Q8M/V68A/Q95S/ L98V/P358E/R478T/I595V/K724H/M792S, Q8M/V68A/ L98V/R221H/S248A/S250D/R440P/D477K/E534H/ I595V/K724H, Q8M/V68A/H788E, Q8M/R93V/Q95S/ L98V/R136S/R221H/I595V/V600I/H788E, Q8M/R93V/ Q95S/L113I/S250D/R440T/I595V/V600I/K724H/H788E, Q8M/Q95S/L98V/R440P/R478V/E534H/V600I/H788E, Q8M/R136S/S248A/R478V/H788E, H47L/M75V/R85V/ A105E/T125E/R129E/I170L/A635S, H47L/M75V/R85V/ A105E/W375Y/I756V/Q776E, H47L/M75V/R85V/I264V/ I267V/I372V/K415R/A635S, H47L/M75V/R85V/I87E/ R129E/W375Y/Q776E, H47L/M75V/R85V/I87E/I170L/ I372V/I756V, H47L/R85V/A105E/R129E/Q201E/N230D/ I267V/R583Q, H47L/R85V/T125E/I372V/R583Q/A635S/ I756V, H47L/R85V/I170L/I756V, H47L/R85V/I87E/ A105E/T125E/A635S, H47L/R85V/I87E/R154H/I756V, H47L/T125E/R129E/W375Y/I756V/Q776E, H47L/R129E/ I170L/A635S, H47L/R154H/I372V/W375Y/R583Q/ A635S/T708A/I756V, V68A/R93V/Q95S/P358E/R440T/ Q444T/R478V/E534H/I595V/G603S, V68A/R93V/Q95S/ Q444T/H788E, V68A/R93V/L98V/R136S/S248A/S250D/ P358E/R440P/E534H/K724H, M75V/R85V/I87E/A105E/ I264V/I267V/R583Q/T708A, M75V/R85V/R129E/R154H/ I264V/W375Y, R85V/T125E/I215F/W375Y/K415R/ A635S/Q776E, R85V/I87E/A105E/I215F/I267V/I756V, R85V/I87E/R129E/W375Y/I756V/Q776E, I87E/T125E/ R129E/I170L/N230D/I756V, I87E/R154H/R306L/W375Y/ I756V, R93V/Q95S/L98V/E534H/M792S, Q95S/R440P/ Q444T/K724H/H788E, R129E/I215F/I372V/I756V, and I170L/I264V/I267V, wherein the positions are numbered with reference to SEQ ID NO: 1158. In some embodiments, the polypeptide sequence of the engineered sucrose synthase comprises a sequence at least 90% identical to any of SEQ ID NOS: 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, and/or 1288. In some further embodiments, the polypeptide sequence of the engineered sucrose synthase comprises a sequence at least 95% identical to any of SEQ ID NOS: 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, and/or 1288. In some embodiments, the polypeptide sequence of the engineered sucrose synthase comprises any of SEQ ID NOS: 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, and/or 1288.

The present invention also provides engineered sucrose synthases, wherein the polypeptide sequence of the engineered sucrose synthases comprise at least one mutation or mutation set at one or more positions selected from 47/68/ 93/98/358/440, 47/68/154/372/375, 47/93/98/136/154/772/ 776, 47/93/98/154/372/375/776, 47/93/98/358/583/635, 47/93/129/136/154/250/372/534/635/724, 47/93/129/136/ 375/534/583, 47/93/358/372/375/440/724, 47/93/358/372/ 375/776, 47/98/129/358/372/375/438/534, 47/98/129/375/ 534/635/724/776, 47/98/372/375, 47/125/154, 47/129/136/ 372/375/534, 47/129/248/250/372/375/534/724, 47/136/ 583/776, 47/358/440/724, 47/358/635/776, 47/372/635/776, 68/93/98/129/358/375/724, 68/93/154/358/372/440/776, 68/129/440, 68/129/583/724, 68/136/724, 68/154/358/375, 68/154/534/635, 68/375/440/534/724/776, 93/98/125/154/ 248, 93/98/125/154/250/440, 93/98/129/154/248, 93/98/ 154/250/358/375/534, 93/98/154/635/776, 93/98/534, 93/125/154/440/534, 93/129/250/358/372/375/583, 93/154/

248/724, 93/358/534/635, 98/129/375/583, 98/534/583/635, 129/136/154/248/250/372/375/534, 129/136/375, 129/154/248/250/358/375/534/635, 129/358/372/635, 154/250/358/375/583, 154/358/375/534/776, 154/534/635/724, 372/375/776, 375/635, and 534/583, wherein the positions are numbered with reference to SEQ ID NO: 1222. In some embodiments, the polypeptide sequence of the engineered sucrose synthase comprises at least one mutation or mutation set at one or more positions selected from 47L/68A/93V/98V/358E/440P, 47L/68A/154H/372V/375Y, 47L/93V/98V/136S/154H/772G/776E, 47L/93V/98V/154H/372V/375Y/776E, 47L/93V/98V/358E/583Q/635S, 47L/93V/129E/1365/154H/250D/372V/534H/635S/724H, 47L/93V/129E/136S/375Y/534H/583Q, 47L/93V/358E/372V/375Y/440P/724H, 47L/93V/358E/372V/375Y/776E, 47L/98V/129E/358E/372V/375Y/438Q/534H, 47L/98V/129E/375Y/534H/635S/724H/776E, 47L/98V/372V/375Y, 47L/125E/154H, 47L/129E/136S/372V/375Y/534H, 47L/129E/248A/250D/372V/375Y/534H/724H, 47L/136S/583Q/776E, 47L/358E/440P/724H, 47L/358E/635S/776E, 47L/372V/635S/776E, 68A/93V/98V/129E/358E/375Y/724H, 68A/93V/154H/358E/372V/440P/776E, 68A/129E/440P, 68A/129E/583Q/724H, 68A/136S/724H, 68A/154H/358E/375Y, 68A/154H/534H/635S, 68A/375Y/440P/534H/724H/776E, 93V/98V/125E/154H/248A, 93V/98V/125E/154H/250D/440P, 93V/98V/129E/154H/248A, 93V/98V/154H/250D/358E/375Y/534H, 93V/98V/154H/635S/776E, 93V/98V/534H, 93V/125E/154H/440P/534H, 93V/129E/250D/358E/372V/375Y/583Q, 93V/154H/248A/724H, 93V/358E/534H/635S, 98V/129E/375Y/583Q, 98V/534H/583Q/635S, 129E/136S/154H/248A/250D/372V/375Y/534H, 129E/136S/375Y, 129E/154H/248A/250D/358E/375Y/534H/635S, 129E/358E/372V/635S, 154H/250D/358E/375Y/583Q, 154H/358E/375Y/534H/776E, 154H/534H/635S/724H, 372V/375Y/776E, 375Y/635S, and 534H/583Q, wherein the positions are numbered with reference to SEQ ID NO: 1222. In some embodiments, the polypeptide sequence of the engineered sucrose synthase comprises at least one mutation or mutation set at one or more positions selected from H47L/V68A/R93V/L98V/P358E/R440P, H47L/V68A/R154H/I372V/W375Y, H47L/R93V/L98V/R136S/R154H/E772G/Q776E, H47L/R93V/L98V/R154H/I372V/W375Y/Q776E, H47L/R93V/L98V/P358E/R583Q/A635S, H47L/R93V/R129E/R136S/R154H/S250D/I372V/E534H/A635S/K724H, H47L/R93V/R129E/R136S/W375Y/E534H/R583Q, H47L/R93V/P358E/I372V/W375Y/R440P/K724H, H47L/R93V/P358E/I372V/W375Y/Q776E, H47L/L98V/R129E/P358E/I372V/W375Y/H438Q/E534H, H47L/L98V/R129E/W375Y/E534H/A635S/K724H/Q776E, H47L/L98V/I372V/W375Y, H47L/T125E/R154H, H47L/R129E/R136S/I372V/W375Y/E534H, H47L/R129E/S248A/S250D/I372V/W375Y/E534H/K724H, H47L/R136S/R583Q/Q776E, H47L/P358E/R440P/K724H, H47L/P358E/A635S/Q776E, H47L/I372V/A635S/Q776E, V68A/R93V/L98V/R129E/P358E/W375Y/K724H, V68A/R93V/R154H/P358E/I372V/R440P/Q776E, V68A/R129E/R440P, V68A/R129E/R583Q/K724H, V68A/R136S/K724H, V68A/R154H/P358E/W375Y, V68A/R154H/E534H/A635S, V68A/W375Y/R440P/E534H/K724H/Q776E, R93V/L98V/T125E/R154H/S248A, R93V/L98V/T125E/R154H/S250D/R440P, R93V/L98V/R129E/R154H/S248A, R93V/L98V/R154H/S250D/P358E/W375Y/E534H, R93V/L98V/R154H/A635S/Q776E, R93V/L98V/E534H, R93V/T125E/R154H/R440P/E534H, R93V/R129E/S250D/P358E/I372V/W375Y/R583Q, R93V/R154H/S248A/K724H, R93V/P358E/E534H/A635S, L98V/R129E/W375Y/R583Q, L98V/E534H/R583Q/A635S, R129E/R136S/R154H/S248A/S250D/1372V/W375Y/E534H, R129E/R136S/W375Y, R129E/R154H/S248A/S250D/P358E/W375Y/E534H/A635S, R129E/P358E/1372V/A635S, R154H/S250D/P358E/W375Y/R583Q, R154H/P358E/W375Y/E534H/Q776E, R154H/E534H/A635S/K724H, I372V/W375Y/Q776E, W375Y/A635S, and E534H/R583Q, wherein the positions are numbered with reference to SEQ ID NO: 1222. In some embodiments, the polypeptide sequence of the engineered sucrose synthase comprises a sequence at least 90% identical to any of SEQ ID NOS: 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, and 1392. In some embodiments, the polypeptide sequence of the engineered sucrose synthase comprises a sequence at least 95% identical to any of SEQ ID NOS: 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, and 1392. In some embodiments, the polypeptide sequence of the engineered sucrose synthase comprises any of SEQ ID NOS: 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, and 1392.

The present invention also provides engineered sucrose synthases, wherein the polypeptide sequence of the engineered sucrose synthases comprise at least one mutation or mutation set at one or more positions selected from 17/357/364/434/519/684, 17/357/434/519/684, 17/434/684, 17/684, 54/97/118/307/694/727/738, 68/98/129/136, 68/98/129/136/154, 68/98/129/136/154/534, 68/98/129/154/534, 68/98/129/154/635, 68/98/136/154/534/635, 68/98/136/154/635, 68/98/154, 68/98/154/534, 68/98/154/534/635, 68/129/136, 68/129/136/154, 68/129/136/154/464/635, 68/129/136/534/635, 68/129/154, 68/129/154/765, 68/136/154/534/635, 68/136/534/635, 68/136/635, 68/154, 68/154/534/635, 68/154/635, 97/118/442/694/727/738, 98/129/136/154, 98/129/136/154/635, 98/129/136/534, 98/129/136/635, 98/129/154, 98/129/154/534/635, 98/129/534/635, 98/136/154/635, 98/136/534/635, 98/136/635, 98/154, 98/154/534, 122, 129/136, 129/136/154/635, 129/136/534, 129/136/635, 129/154/534, 129/154/635, 129/635, 132/136/154/534/635, 136/154/635, 136/534/635, 136/603, 136/635, 154, 154/635, 157, 160, 161, 167, 253, 285, 381, 519, 550, 563, 564, 635, and 785, wherein the positions are numbered with reference to SEQ ID NO: 1392. In some embodiments, the polypeptide sequence of the engineered sucrose synthase comprises at least one mutation or mutation set at one or more positions selected from 17D/357K/364R/434H/519T/684H, 17D/357K/434H/519T/684H, 17D/434H/684H, 17D/684H, 54D/97V/118N/307E/694N/727E/738E, 68A/98V/129E/136S, 68A/98V/129E/136S/154H, 68A/98V/129E/136S/154H/534H, 68A/98V/129E/154H/534H, 68A/98V/129E/154H/635S, 68A/98V/136S/154H/534H/635S, 68A/98V/136S/154H/635S, 68A/98V/154H, 68A/98V/154H/534H, 68A/98V/154H/534H/635S, 68A/129E/136S, 68A/129E/136S/154H, 68A/129E/136S/154H/464F/635S, 68A/129E/136S/534H/635S, 68A/129E/154H, 68A/129E/154H/765H, 68A/136S/154H/534H/635S, 68A/136S/534H/635S, 68A/1365/

6355, 68A/154H, 68A/154H/534H/635S, 68A/154H/635S, 97V/118N/442N/694N/727E/738E, 98V/129E/136S/154H, 98V/129E/136S/154H/635S, 98V/129E/136S/534H, 98V/129E/1365/6355, 98V/129E/154H, 98V/129E/154H/534H/635S, 98V/129E/534H/635S, 98V/136S/154H/635S, 98V/136S/534H/635S, 98V/136S/635S, 98V/154H, 98V/154H/534H, 122D, 122E, 129E/136S, 129E/136S/154H/635S, 129E/136S/534H, 129E/1365/6355, 129E/154H/534H, 129E/154H/635S, 129E/635S, 132C/136S/154H/534H/635S, 136S/154H/635S, 136S/534H/635S, 136S/603D, 1365/6355, 154H, 154H/635S, 157A, 157F, 160A, 160E, 160M, 160N, 1605, 160W, 161Q, 167E, 253G, 253T, 253V, 285A, 3815, 519A, 519G, 519L, 5195, 519T, 5501, 550M, 550Q, 5505, 563V, 564A, 635D, 635E, 635R, and 785D, wherein the positions are numbered with reference to SEQ ID NO: 1392. In some embodiments, the polypeptide sequence of the engineered sucrose synthase comprises at least one mutation or mutation set at one or more positions selected from Y17D/Y357K/P364R/Y434H/F519T/F684H, Y17D/Y357K/Y434H/F519T/F684H, Y17D/Y434H/F684H, Y17D/F684H, G54D/A97V/A118N/N307E/G694N/L727E/A738E, V68A/L98V/R129E/R136S, V68A/L98V/R129E/R136S/R154H, V68A/L98V/R129E/R136S/R154H/E534H, V68A/L98V/R129E/R154H/E534H, V68A/L98V/R129E/R154H/A635S, V68A/L98V/R136S/R154H/E534H/A635S, V68A/L98V/R136S/R154H/A635S, V68A/L98V/R154H, V68A/L98V/R154H/E534H, V68A/L98V/R154H/E534H/A635S, V68A/R129E/R136S, V68A/R129E/R136S/R154H, V68A/R129E/R136S/R154H/I464F/A635S, V68A/R129E/R136S/E534H/A635S, V68A/R129E/R154H, V68A/R129E/R154H/D765H, V68A/R136S/R154H/E534H/A635S, V68A/R136S/E534H/A635S, V68A/R136S/A635S, V68A/R154H, V68A/R154H/E534H/A635S, V68A/R154H/A635S, A97V/A118N/H442N/G694N/L727E/A738E, L98V/R129E/R136S/R154H, L98V/R129E/R136S/R154H/A635S, L98V/R129E/R136S/E534H, L98V/R129E/R136S/A635S, L98V/R129E/R154H, L98V/R129E/R154H/E534H/A635S, L98V/R129E/E534H/A635S, L98V/R136S/R154H/A635S, L98V/R136S/E534H/A635S, L98V/R136S/A635S, L98V/R154H, L98V/R154H/E534H, A122D, A122E, R129E/R136S, R129E/R136S/R154H/A635S, R129E/R136S/E534H, R129E/R136S/A635S, R129E/R154H/E534H, R129E/R154H/A635S, R129E/A635S, R132C/R136S/R154H/E534H/A635S, R136S/R154H/A635S, R136S/E534H/A635S, R136S/G603D, R136S/A635S, R154H, R154H/A635S, G157A, G157F, F160A, F160E, F160M, F160N, F160S, F160W, S161Q, R167E, A253G, A253T, A253V, P285A, Q381S, F519A, F519G, F519L, F519S, F519T, R550I, R550M, R550Q, R550S, L563V, S564A, A635D, A635E, A635R, and P785D, wherein the positions are numbered with reference to SEQ ID NO: 1392. In some embodiments, the polypeptide sequence of the engineered sucrose synthase comprises a sequence at least 90% identical to any of SEQ ID NOS: 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, and 1566. In some embodiments, the polypeptide sequence of the engineered sucrose synthase comprises a sequence at least 95% identical to any of SEQ ID NOS: 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, and 1566. In some embodiments, the polypeptide sequence of the engineered sucrose synthase comprises any of SEQ ID NOS: 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, and 1566.

The present invention also provides engineered sucrose synthases, wherein the polypeptide sequence of the engineered sucrose synthases comprise at least one mutation or mutation set at one or more positions selected from 17/54/97/136/329/550/684/738, 17/54/97/329/524/684, 17/54/161/519/727/738, 17/54/524/550/727, 17/161/434/524/766, 17/434/524/684, 17/434/738, 17/442/524/550/684/721, 17/727, 17/738, 54/97/161/434/442, 54/97/434/524/550/684/727, 54/136/442/550, 54/434/524/738, 97/136/519/550/727/738, and 329/550/684/727/738, wherein the positions are numbered with reference to SEQ ID NO: 1456. In some embodiments, the polypeptide sequence of the engineered sucrose synthase comprises at least one mutation or mutation set at one or more positions selected from 17D/54D/97V/136P/329Q/550I/684H/738E, 17D/54D/97V/329Q/524T/684H, 17D/54D/161T/519T/727E/738E, 17D/54D/524T/550I/727E, 17D/161T/434H/524T/766H, 17D/434H/524T/684H, 17D/434H/738E, 17D/442N/524T/550I/684H/721K, 17D/727E, 17D/738E, 54D/97V/161T/434H/442N, 54D/97V/434H/524T/550I/684H/727E, 54D/136P/442N/550I, 54D/434H/524T/738E, 97V/136P/519T/550I/727E/738E, and 329Q/550I/684H/727E/738E, wherein the positions are numbered with reference to SEQ ID NO: 1456. In some embodiments, the polypeptide sequence of the engineered sucrose synthase comprises at least one mutation or mutation set at one or more positions selected from Y17D/G54D/A97V/R136P/E329Q/R550I/F684H/A738E, Y17D/G54D/A97V/E329Q/A524T/F684H, Y17D/G54D/S161T/F519T/L727E/A738E, Y17D/G54D/A524T/R550I/L727E, Y17D/S161T/Y434H/A524T/R766H, Y17D/Y434H/A524T/F684H, Y17D/Y434H/A738E, Y17D/H442N/A524T/R550I/F684H/E721K, Y17D/L727E, Y17D/A738E, G54D/A97V/S161T/Y434H/H442N, G54D/A97V/Y434H/A524T/R550I/F684H/L727E, G54D/R136P/H442N/R550I, G54D/Y434H/A524T/A738E, A97V/R136P/F519T/R550I/L727E/A738E, and E329Q/R550I/F684H/L727E/A738E, wherein the positions are numbered with reference to SEQ ID NO: 1456. In some embodiments, the polypeptide sequence of the engineered sucrose synthase comprises a sequence at least 90% identical to any of SEQ ID NOS: 1568, 1570, 1572, 1574, 1576, 1578, 1580, 1582, 1584, 1586, 1588, 1590, 1592, 1594, 1596, and 1598. In some embodiments, the polypeptide sequence of the engineered sucrose synthase comprises a sequence at least 95% identical to any of SEQ ID NOS: 1568, 1570, 1572, 1574, 1576, 1578, 1580, 1582, 1584, 1586, 1588, 1590, 1592, 1594, 1596, and 1598. In some embodiments, the polypeptide sequence of the engineered sucrose synthase comprises any of SEQ ID NOS: 1568, 1570, 1572, 1574, 1576, 1578, 1580, 1582, 1584, 1586, 1588, 1590, 1592, 1594, 1596, and 1598.

The present invention also provides engineered sucrose synthases, wherein the polypeptide sequence of the engineered sucrose synthases comprise at least one mutation or mutation set at one or more positions selected from 14/137/ 356/745, 14/570, 14/570/745, 26/117/365, 26/164/165/213/ 586, 71/158/222/356, 71/222/236, 71/319/356/606, 117/ 158/213/332/608, 117/164/707, 117/213/365/517, 117/311/ 332, 117/608, 122, 122/160/161/167/550, 122/160/161/282/ 381/550, 122/160/161/282/381/550/636, 122/160/161/282/ 550, 122/160/161/550/636, 122/160/167/282/381/550/636, 122/160/282/381, 122/160/282/381/550, 122/160/282/550, 122/160/381/550, 122/160/381/550/636, 122/160/550, 122/ 160/550/636, 122/161/550, 122/167, 122/167/550, 122/282/ 381/550, 122/282/550, 122/282/550/636, 122/381/706, 122/ 550, 137/319/570, 157/253/519, 160/161, 160/161/282/381/ 550, 160/161/282/550, 160/161/550/636/735, 160/167/282/ 381/636, 160/282, 160/282/381/550, 160/282/550/636, 160/ 381/550/636/681, 161/282/550/636, 161/381/550, 165/311, 167/282/636, 167/550, 213/365/517/707, 236, 253/519, 253/ 519/563, 253/519/635, 253/563/635, 270/322/517, 270/367/ 452/517/613/700/750, 270/452/517/700/750, 270/570, 282/ 381/550, 282/550, 356/570, 381/550, 517, 517/562/750, 517/640, 519/563, 550, 550/636, and 562, wherein the positions are numbered with reference to SEQ ID NO: 1582. In some embodiments, the polypeptide sequence of the engineered sucrose synthase comprises at least one mutation or mutation set at one or more positions selected from 14D/137K/356H/745L, 14D/570H, 14D/570H/745L, 26E/ 117E/365E, 26E/164E/165E/213E/586E, 71Q/158T/222L/ 356H, 71Q/222L/2365, 71Q/319K/356H/6065, 117E/158E/ 213E/332E/608E, 117E/164E/707E, 117E/213E/365E/ 517E, 117E/311E/332E, 117E/608E, 122D, 122D/160M/ 282M/550S, 122D/160W/161Q/167E/550M, 122D/160W/ 161Q/282M/550Q, 122D/160W/282M/381S/550M, 122D/ 160W/550M, 122D/160W/550Q/636Q, 122D/167E, 122D/ 282M/381S/550M, 122D/282M/550Q, 122D/550M, 122E/ 160I/167E/282M/381H/550Q/636Q, 122E/160M/161Q/ 282M/381S/550M/636Q, 122E/160M/550Q/636Q, 122E/ 160W/161Q/167E/550S, 122E/160W/161Q/282M/3815/ 5505, 122E/160W/161Q/550M/636Q, 122E/160W/282M/ 381s, 122E/160W/381S/550M/636Q, 122E/160W/381S/ 550Q, 122E/161Q/550Q, 122E/167E/550M, 122E/282M/ 550M/636Q, 122E/282M/550Q, 122E/282M/550S, 122E/ 3815/706K, 122E/550Q, 137K/319K/570H, 157A/253T/ 519L, 160M/161Q, 160M/161Q/282M/381S/550M, 160M/ 161Q/282M/550Q, 160M/282M, 160M/282M/381S/550M, 160M/282M/550M/636Q, 160W/161Q/282M/550M, 160W/161Q/282M/550Q, 160W/161Q/550Q/636Q/735V, 160W/167E/282M/381S/636Q, 160W/282M/381S/550M, 160W/381S/550Q/636Q/681V, 161Q/282M/550Q/636Q, 161Q/381S/550Q, 165E/311E, 167E/282M/636Q, 167E/ 550Q, 213E/365E/517E/707E, 2365, 253G/519L, 253T/ 519L, 253T/519L/563V, 253T/519L/635D, 253T/519L/ 635E, 253T/563V/635R, 253V/519G, 253V/519L, 270L/ 322V/517A, 270L/367V/452Y/517A/613Q/700F/750M, 270L/452Y/517A/700F/750M, 270L/570H, 282M/381S/ 550S, 282M/550Q, 356H/570H, 381S/550Q, 381S/550S, 517A, 517A/562I/750M, 517A/640N, 519L/563V, 550M/ 636Q, 550Q, and 562, wherein the positions are numbered with reference to SEQ ID NO: 1582. In some embodiments, the polypeptide sequence of the engineered sucrose synthase comprises at least one mutation or mutation set at one or more positions selected from R14D/R137K/R356H/R745L, R14D/R570H, R14D/R570H/R745L, S26E/G117E/H365E, S26E/A164E/A165E/A213E/R586E, R71Q/R158T/R222L/ R356H, R71Q/R222L/R236S, R71Q/R319K/R356H/ R606S, G117E/R158E/A213E/G332E/A608E, G117E/ A164E/A707E, G117E/A213E/H365E/P517E, G117E/ Q311E/G332E, G117E/A608E, A122D, A122D/F160M/ L282M/R550S, A122D/F160W/T161Q/R167E/R550M, A122D/F160W/T161Q/L282M/R550Q, A122D/F160W/ L282M/Q381S/R550M, A122D/F160W/R550M, A122D/ F160W/R550Q/L636Q, A122D/R167E, A122D/L282M/ Q381S/R550M, A122D/L282M/R550Q, A122D/R550M, A122E/F160I/R167E/L282M/Q381H/R550Q/L636Q, A122E/F160M/T161Q/L282M/Q381S/R550M/L636Q, A122E/F160M/R550Q/L636Q, A122E/F160W/T161Q/ R167E/R550S, A122E/F160W/T161Q/L282M/Q381S/ R550S, A122E/F160W/T161Q/R550M/L636Q, A122E/ F160W/L282M/Q381S, A122E/F160W/Q381S/R550M/ L636Q, A122E/F160W/Q381S/R550Q, A122E/T161Q/ R550Q, A122E/R167E/R550M, A122E/L282M/R550M/ L636Q, A122E/L282M/R550Q, A122E/L282M/R550S, A122E/Q381S/E706K, A122E/R550Q, R137K/R319K/ R570H, G157A/A253T/T519L, F160M/T161Q, F160M/ T161Q/L282M/Q381S/R550M, F160M/T161Q/L282M/ R550Q, F160M/L282M, F160M/L282M/Q381S/R550M, F160M/L282M/R550M/L636Q, F160W/T161Q/L282M/ R550M, F160W/T161Q/L282M/R550Q, F160W/T161Q/ R550Q/L636Q/A735V, F160W/R167E/L282M/Q381S/ L636Q, F160W/L282M/Q381S/R550M, F160W/Q381S/ R550Q/L636Q/A681V, T161Q/L282M/R550Q/L636Q, T161Q/Q381S/R550Q, A165E/Q311E, R167E/L282M/ L636Q, R167E/R550Q, A213E/H365E/P517E/A707E, R236S, A253G/T519L, A253T/T519L, A253T/T519L/ L563V, A253T/T519L/S635D, A253T/T519L/S635E, A253T/L563V/S635R, A253V/T519G, A253V/T519L, V270L/I322V/P517A, V270L/I367V/F452Y/P517A/ E613Q/I700F/L750M, V270L/F452Y/P517A/I700F/ L750M, V270L/R570H, L282M/Q381S/R550S, L282M/ R550Q, R356H/R570H, Q381S/R550Q, Q381S/R550S, P517A, P517A/L562I/L750M, P517A/T640N, T519L/ L563V, R550M/L636Q, R550Q, and L562I, wherein the positions are numbered with reference to SEQ ID NO: 1582. In some embodiments, the polypeptide sequence of the engineered sucrose synthase comprises a sequence at least 90% identical to any of SEQ ID NOS: 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, and 1772. In some embodiments, the polypeptide sequence of the engineered sucrose synthase comprises a sequence at least 95% identical to any of SEQ ID NOS: 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, and 1772. In some embodiments, the polypeptide sequence of the engineered sucrose synthase comprises any of SEQ ID NOS: 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, and 1772.

The present invention also provides engineered sucrose synthases, wherein the polypeptide sequence of the engineered sucrose synthases comprise at least one mutation or mutation set at one or more positions selected from 63/536, 117/122/270/540/681, 181/536/548, 181/536/548/705, 181/548/705, 270/681, 347/532, 347/536/548/705, 407/570/681, 407/681, 536, 536/548, 536/548/699, 536/705, 548, 548/580, 548/705, 580, 681, 699, and 705, wherein the positions are numbered with reference to SEQ ID NO: 1764. In some embodiments, the polypeptide sequence of the engineered sucrose synthase comprises at least one mutation or mutation set at one or more positions selected from 63I/536L, 117E/122D/270L/540M/681A, 181N/536L/548P, 181N/536L/548P/705M, 181N/548P/705P, 270L/681A, 347R/532Y, 347R/536L/548P/705P, 407I/570H/681A, 407T/681A, 536L, 536L/548P, 536L/548P/699F, 536L/705M, 548P, 548P/580M, 548P/705P, 580M, 681A, 699F, 705M, and 705P, wherein the positions are numbered with reference to SEQ ID NO: 1764. In some embodiments, the polypeptide sequence of the engineered sucrose synthase comprises at least one mutation or mutation set at one or more positions selected from A63I/E536L, G117E/A122D/V270L/L540M/V681A, G181N/E536L/A548P, G181N/E536L/A548P/H705M, G181N/A548P/H705M, V270L/V681A, N347R/S532Y, N347R/E536L/A548P/H705P, L407I/R570H/V681A, L407T/V681A, E536L, E536L/A548P, E536L/A548P/H699F, E536L/H705M, A548P, A548P/L580M, A548P/H705P, L580M, V681A, H699F, H705M, and H705P, wherein the positions are numbered with reference to SEQ ID NO: 1764. In some embodiments, the polypeptide sequence of the engineered sucrose synthase comprises a sequence at least 90% identical to any of SEQ ID NOS: 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, and 1820. In some embodiments, the polypeptide sequence of the engineered sucrose synthase comprises a sequence at least 95% identical to any of SEQ ID NOS: 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, and 1820. In some embodiments, the polypeptide sequence of the engineered sucrose synthase comprises any of SEQ ID NOS: 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, and 1820.

The present invention also provides engineered sucrose synthases, wherein the polypeptide sequence of the engineered sucrose synthases comprise at least one mutation or mutation set at one or more positions selected from 13, 17, 18, 30, 37, 52, 57, 60, 71, 85, 87, 90, 98, 99, 118, 129, 164, 180, 183, 347/434/517/562/640/681, 347/434/532/640/681, 347/434/550/562/681, 347/434/681, 347/517/532/681, 347/532/550/640/681/699, 347/536/562/681, 347/550/580/681, 347/550/681, 347/681, 365, 388, 389, 415, 433, 434/517/532/681, 517/681, 531, 532/681, 535, 536/580/681, 539, 562/681, 589, 606, 608, 707, 711, 727, 738, 748, 765, 769, and 789, wherein the positions are numbered with reference to SEQ ID NO: 1804. In some embodiments, the polypeptide sequence of the engineered sucrose synthase comprises at least one mutation or mutation set at one or more positions selected from 13H, 13K, 13N, 17R, 18G, 30H, 37G, 37R, 52G, 52P, 52R, 52W, 57R, 57W, 60L, 71G, 71Q, 85H, 87H, 87L, 90H, 98L, 99I, 118G, 118N, 129A, 129G, 129T, 164S, 164T, 180P, 183P, 347R/434H/517A/562I/640N/681A, 347R/434H/532Y/562I/640N/681A, 347R/434H/550I/562I/681A, 347R/434H/681A, 347R/517A/532Y/681A, 347R/532Y/550I/640N/681A/699F, 347R/536L/562I/681A, 347R/550I/580M/681A, 347R/550I/681A, 347R/681A, 365W, 388K, 388R, 389G, 415H, 433K, 433P, 434H/517A/532Y/681A, 517A/681A, 531A, 531R, 531T, 532Y/681A, 535A, 535H, 535S, 536L/580M/681A, 539A, 539R, 562I/681A, 589S, 606A, 606H, 606I, 606L, 606M, 606Q, 606V, 608P, 707G, 711K, 727K, 738S, 748T, 765A, 765S, 769K, 769R, 789N, and 789R, wherein the positions are numbered with reference to SEQ ID NO: 1804. In some embodiments, the polypeptide sequence of the engineered sucrose synthase comprises at least one mutation or mutation set at one or more positions selected from P13H, P13K, P13N, D17R, A18G, S30H, Q37G, Q37R, D52G, D52P, D52R, D52W, P57R, P57W, D60L, R71G, R71Q, V85H, E87H, E87L, R90H, V98L, E99I, A118G, A118N, E129A, E129G, E129T, A164S, A164T, D180P, N183P, N347R/Y434H/P517A/L562I/T640N/V681A, N347R/Y434H/S532Y/L562I/T640N/V681A, N347R/Y434H/Q550I/L562I/V681A, N347R/Y434H/V681A, N347R/P517A/S532Y/V681A, N347R/S532Y/Q550I/T640N/V681A/H699F, N347R/E536L/L562I/V681A, N347R/Q550I/L580M/V681A, N347R/Q550I/V681A, N347R/V681A, H365W, L388K, L388R, A389G, K415H, L433K, L433P, Y434H/P517A/S532Y/V681A, P517A/V681A, S531A, S531R, S531T, S532Y/V681A, P535A, P535H, P535S, E536L/L580M/V681A, S539A, S539R, L562I/V681A, G589S, R606A, R606H, R606I, R606L, R606M, R606Q, R606V, A608P, A707G, R711K, E727K, E738S, E748T, D765A, D765S, Q769K, Q769R, A789N, and A789R, wherein the positions are numbered with reference to SEQ ID NO: 1804. In some embodiments, the polypeptide sequence of the engineered sucrose synthase comprises a sequence at least 90% identical to any of SEQ ID NOS: 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, and 1984. In some embodiments, the polypeptide sequence of the engineered sucrose synthase comprises a sequence at least 95% identical to any of SEQ ID NOS: 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, and 1984. In some embodiments, the polypeptide sequence of the engineered sucrose synthase comprises any of SEQ ID NOS: 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, and 1984.

The present invention also provides engineered sucrose synthases, wherein the polypeptide sequence of the engineered sucrose synthases comprise at least one mutation or mutation set at one or more positions selected from 17/52/87/118/129/388/589/738/765, 17/52/87/118/129/589/738, 17/52/87/118/129/589/738/765, 17/52/87/118/129/589/765, 17/52/87/129/388/589, 17/52/87/129/388/589/738, 17/52/87/129/738, 17/52/87/388/589/765, 17/52/87/589/738/765, 17/52/118/129/265/589/765, 17/52/118/129/388/589/738/765, 17/52/118/129/589/738/765, 17/52/118/129/738/765, 17/52/118/388/589/738, 17/52/118/388/589/738/765, 17/52/118/388/738/765, 17/52/129/388/589/738, 17/52/129/388/589/738/765, 17/52/129/589, 17/52/129/589/738, 17/52/129/589/765, 17/52/129/653/738/765, 17/52/129/738, 17/52/129/738/765, 17/52/388/589/738, 17/52/388/589/738/765, 17/52/589/738/765, 17/52/589/765, 17/87/118/388/738, 17/87/129/388/738, 17/118/129/388/738/765, 17/129/589, 17/129/589/738, 17/129/589/738/765, 17/129/738/765, 17/388/589/738, 17/589/738, 17/589/765, 17/738/765, 52/84/129/388/738/765, 52/87/118/129/388/765, 52/87/118/388/589/738, 52/87/118/589/738/765, 52/87/129/388/738/765, 52/87/129/765, 52/87/589/738, 52/87/738, 52/118/129/589/738, 52/118/129/765, 52/118/388/589/738, 52/118/388/738/765, 52/129/589/738/765, 52/129/589/765, 52/129/738, 52/388/738/765, 52/589/738, 52/589/738/765, 52/738/765, 84/129/589/738/765, 87/118/129/765, 87/129/388/589, and 589/738/765, wherein the positions are numbered with reference to SEQ ID NO: 1840. In some embodiments, the polypeptide sequence of the engineered sucrose synthase comprises at least one mutation or mutation set at one or more positions selected from 17R/52G/87H/118N/129N/589S/738S, 17R/52G/87H/118N/129T/589S/765S, 17R/52G/87H/129T/388K/589S/738S, 17R/52G/87H/129T/738S, 17R/52G/87H/388K/589S/765S, 17R/52G/118N/129T/388K/589S/738S/765S, 17R/52G/118N/388K/738S/765S, 17R/52G/129G/589S/738S, 17R/52G/129T/388K/589S/738S, 17R/52G/129T/589S, 17R/52G/129T/653H/738S/765S, 17R/52G/589S/765S, 17R/52P/87H/118N/129T/388K/589S/738S/765S, 17R/52P/87H/118N/129T/589S/738S/765S, 17R/52P/87H/129G/388K/589S, 17R/52P/87H/129T/388K/589S/738S, 17R/52P/87H/589S/738S/765S, 17R/52P/118N/129T/265T/589S/765S, 17R/52P/118N/129T/589S/738S/765S, 17R/52P/118N/129T/738S/765S, 17R/52P/118N/388K/589S/738S, 17R/52P/118N/388K/589S/738S/765S, 17R/52P/129G/388K/589S/738S/765S, 17R/52P/129G/738S/765S, 17R/52P/129T/589S/765S, 17R/52P/129T/738S, 17R/52P/388K/589S/738S, 17R/52P/388K/589S/738S/765S, 17R/52P/589S/738S/765S, 17R/87H/118N/388K/738S, 17R/87H/129T/388K/738S, 17R/118N/129T/388K/738S/765S, 17R/129T/589S, 17R/129T/589S/738S, 17R/129T/589S/738S/765S, 17R/129T/738S/765S, 17R/388K/589S/738S, 17R/589S/738S, 17R/589S/765S, 17R/738S/765S, 52G/84A/129T/388K/738S/765S, 52G/87H/118N/589S/738S/765S, 52G/87H/129T/388K/738S/765S, 52G/87H/738S, 52G/118N/388K/589S/738S, 52G/118N/388K/738S/765S, 52G/129G/589S/765S, 52G/388K/738S/765S, 52G/589S/738S/765S, 52G/738S/765S, 52P/87H/118N/129T/388K/765S, 52P/87H/118N/388K/589S/738S, 52P/87H/129G/765S, 52P/87H/589S/738S, 52P/118N/129T/589S/738S, 52P/118N/129T/765S, 52P/129T/589S/738S/765S, 52P/129T/738S, 52P/589S/738S, 52P/589S/738S/765S, 84A/129T/589S/738S/765S, 87H/118N/129T/765S, 87H/129T/388K/589S, and 589S/738S/765S, wherein the positions are numbered with reference to SEQ ID NO: 1840. In some embodiments, the polypeptide sequence of the engineered sucrose synthase comprises at least one mutation or mutation set at one or more positions selected from D17R/D52G/E87H/A118N/E129G/G589S/E738S, D17R/D52G/E87H/A118N/E129T/G589S/D765S, D17R/D52G/E87H/E129T/L388K/G589S/E738S, D17R/D52G/E87H/E129T/E738S, D17R/D52G/E87H/L388K/G589S/D765S, D17R/D52G/A118N/E129T/L388K/G589S/E738S/D765S, D17R/D52G/A118N/L388K/E738S/D765S, D17R/D52G/E129G/G589S/E738S, D17R/D52G/E129T/L388K/G589S/E738S, D17R/D52G/E129T/G589S, D17R/D52G/E129T/R653H/E738S/D765S, D17R/D52G/G589S/D765S, D17R/D52P/E87H/A118N/E129T/L388K/G589S/E738S/D765S, D17R/D52P/E87H/A118N/E129T/G589S/E738S/D765S, D17R/D52P/E87H/E129G/L388K/G589S, D17R/D52P/E87H/E129T/L388K/G589S/E738S, D17R/D52P/E87H/G589S/E738S/D765S, D17R/D52P/A118N/E129T/S265T/G589S/D765S, D17R/D52P/A118N/E129T/G589S/E738S/D765S, D17R/D52P/A118N/E129T/E738S/D765S, D17R/D52P/A118N/L388K/G589S/E738S, D17R/D52P/A118N/L388K/G589S/E738S/D765S, D17R/D52P/E129G/L388K/G589S/E738S/D765S, D17R/D52P/E129G/E738S/D765S, D17R/D52P/E129T/G589S/D765S, D17R/D52P/E129T/E738S, D17R/D52P/L388K/G589S/E738S, D17R/D52P/L388K/G589S/E738S/D765S, D17R/D52P/G589S/E738S/D765S, D17R/E87H/A118N/L388K/E738S, D17R/E87H/E129T/L388K/E738S, D17R/A118N/E129T/L388K/E738S/D765S, D17R/E129T/G589S, D17R/E129T/G589S/E738S, D17R/E129T/G589S/E738S/D765S, D17R/E129T/E738S/D765S, D17R/L388K/G589S/E738S, D17R/G589S/E738S, D17R/G589S/D765S, D17R/E738S/D765S, D52G/G84A/E129T/L388K/E738S/D765S, D52G/E87H/A118N/G589S/E738S/D765S, D52G/E87H/E129T/L388K/E738S/D765S, D52G/E87H/E738S, D52G/A118N/L388K/G589S/E738S, D52G/A118N/L388K/E738S/D765S, D52G/E129G/G589S/D765S, D52G/L388K/E738S/D765S, D52G/G589S/E738S/D765S, D52G/E738S/D765S, D52P/E87H/A118N/E129T/L388K/D765S, D52P/E87H/A118N/L388K/G589S/E738S, D52P/E87H/E129G/D765S, D52P/E87H/G589S/E738S, D52P/A118N/E129T/G589S/E738S, D52P/A118N/E129T/D765S, D52P/E129T/G589S/E738S/D765S, D52P/E129T/E738S, D52P/G589S/E738S, D52P/G589S/E738S/D765S, G84A/E129T/G589S/E738S/D765S, E87H/A118N/E129T/D765S, E87H/E129T/L388K/G589S, and G589S/E738S/D765S, wherein the positions are numbered with reference to SEQ ID NO: 1840. In some embodiments, the polypeptide sequence of the engineered sucrose synthase comprises at least one mutation or mutation set at one or more positions selected from 14, 15, 18/362, 20, 24, 26, 33, 33/154, 46, 50, 54, 58, 59, 59/72, 79, 81, 92, 93, 97/154, 104, 105, 130, 134, 154, 165, 175, 185, 212, 213, 218, 241, 256, 263, 316, 319, 349, 360, 362, 364, 390, 393, 434, 480, 498, 530, 534, 534/739, 542, 603, and 652, wherein the positions are numbered with reference to SEQ ID NO: 1840. In some embodiments, the polypeptide sequence of the engineered sucrose synthase comprises at least one mutation or mutation set at one or more positions selected from 14K, 15A, 15I, 15P, 18V/362A, 20M, 245, 26A, 26E, 26I, 26T, 33H/154C, 33L, 33P, 335, 46G, 46I, 46R, 46T, 46V, 50R, 54M, 58M, 59A, 59C, 59N/72N, 59R, 59S, 59V, 59W, 79H, 79Y, 81G, 81I, 81L, 92G, 93T, 97V/154S, 104T, 105S, 130Y, 134A, 134P, 154A, 154E, 154R, 154S, 165I, 165L, 165T, 175G, 175T, 185L, 212Y, 213V, 218A, 218N, 218Q, 218S, 218T, 218V, 241T, 256G, 263S, 263Y, 316H, 316T, 319S, 349D, 349R, 349T, 360D, 360E, 360R, 362E, 364S, 390M, 393H, 434G, 434R, 480P, 480V, 498L, 498Q, 530F, 534G, 534K, 534L, 534R, 534T, 534W, 534W/739K, 542W, 603A, 603E, 603H, 603Q, 603S, 652K, 652L, 652R, 652S, and 652T, wherein the positions are numbered with reference to SEQ ID NO: 1840. In some embodiments, the polypeptide sequence of the engineered sucrose synthase comprises at least one mutation or mutation set at one or more positions selected from R14K, S15A, S15I, S15P, A18V/I362A, L20M, V24S, S26A, S26E, S26I, S26T, Q33H/H154C, Q33L, Q33P, Q33S, Q46G, Q46I, Q46R, Q46T, Q46V, G50R, D54M, L58M, E59A, E59C, E59N/D72N, E59R, E59S, E59V, E59W, W79H, W79Y, P81G, P81I, P81L, H92G, V93T, A97V/H154S, D104T, E105S, D130Y, V134A, V134P, H154A, H154E, H154R, H154S, A165I, A165L, A165T, S175G, S175T, M185L, W212Y, A213V, D218A, D218N, D218Q, D218S, D218T, D218V, L241T, S256G, M263S, M263Y, V316H, V316T, R319S, Q349D, Q349R, Q349T, G360D, G360E, G360R, I362E, P364S, E390M, S393H, Y434G, Y434R, I480P, I480V, E498L, E498Q, P530F, E534G, E534K, E534L, E534R, E534T, E534W, E534W/E739K, F542W, G603A, G603E, G603H, G603Q, G603S, G652K, G652L, G652R, G652S, and G652T, wherein the positions are numbered with reference to SEQ ID NO: 1840. In some embodiments, the polypeptide sequence of the engineered sucrose synthase comprises a sequence at least 90% identical to any of SEQ ID NOS: 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, and 2318. In some embodiments, the polypeptide sequence of the engineered sucrose synthase comprises a sequence at least 95% identical to any of SEQ ID NOS: 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, and 2318. In some embodiments, the polypeptide sequence of the engineered sucrose synthase comprises any of SEQ ID NOS: 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, and 2318.

The present invention also provides engineered sucrose synthases, wherein the polypeptide sequence of the engineered sucrose synthases comprise at least one mutation or mutation set at one or more positions selected from 57/71/87/347/434/562/606, 57/71/129/180/434/536/562, 57/71/129/434/531/536/562, 57/71/129/531/532/536/539/606, 57/71/562/606/711/789, 57/71/789, 57/87/180/531/532/562/606/612/711, 57/87/347/562, 57/90/129/562, 57/90/129/562/711, 57/96/129/180/531/532/550/562, 57/129/347/531/532/539/562/711/747, 57/129/347/536/550/562/711/789, 57/129/347/550/711, 57/129/531/539/562/789, 57/129/536/606/789, 57/129/606, 57/180/562, 57/180/562/606/612, 57/347/434/531/532/539/789, 57/434/550/562/606/612/789, 57/531/532/536/562, 57/562/606/711, 57/562/711, 71/129/180/347/531/539/550, 71/129/180/434/532/536/539/711/789, 71/129/531, 71/129/606, 71/347/532/550/562/711, 71/347/536/562/612/789, 71/536/539/562, 87/189/532/536/562/711/789, 87/347/531/606/789, 87/347/536/539/550, 90/129/539/550/606, 129/180/434/562/711/789, 129/180/606/711/789, 129/347/562, 129/536/539/562, 129/539/562/789, 129/550, 129/550/562, 129/562/606/711, 180/532, 180/550/606, 347/531/550/711, 347/536/539/550/711/789, 347/536/562/606/612, 347/550/562/606, 434/531/539/550/562/711, 434/550, 531/532/536/539/562/711/789, 531/532/536/550/562/606/789, 531/532/562/606/711, 532/539/550, and 562/711, wherein the positions are numbered with reference to SEQ ID NO: 2064. In some embodiments, the polypeptide sequence of the engineered sucrose synthase comprises at least one mutation or mutation set at one or more positions selected from 57W/71Q/87H/347R/434H/562I/606H, 57W/71Q/129G/531R/532Y/536L/539R/606H, 57W/71Q/129T/180P/434H/536L/562I, 57W/71Q/129T/434H/531R/536L/562I, 57W/71Q/562I/606M/711K/789N, 57W/71Q/789N, 57W/87H/180P/531R/532Y/562I/606M/612A/711K, 57W/87H/347R/562I, 57W/90H/129G/562I, 57W/90H/129T/562I/711K, 57W/96Q/129T/180P/531R/532Y/550I/562I, 57W/129G/531R/539R/562I/789N, 57W/129G/536L/606M/789N, 57W/129T/347R/531R/532Y/539R/562I/711K/747V, 57W/129T/347R/536L/550I/562I/711K/789N, 57W/129T/347R/550I/711K, 57W/129T/606M, 57W/180P/562I, 57W/180P/562I/606H/612A, 57W/

347R/434H/531R/532Y/539R/789N, 57W/434H/550I/562I/ 606H/612A/789N, 57W/531R/532Y/536L/562I, 57W/ 562I/606M/711K, 57W/562I/711K, 71Q/129T/180P/347R/ 531R/539R/550I, 71Q/129T/180P/434H/532Y/536L/539R/ 711K/789N, 71Q/129T/531R, 71Q/129T/606M, 71Q/347R/ 532Y/550I/562I/711K, 71Q/347R/536L/562I/612A/789N, 71Q/536L/539R/562I, 87H/189D/532Y/536L/562I/711K/ 789N, 87H/347R/531R/606M/789N, 87H/347R/536L/ 539R/550I, 90H/129T/539R/550I/606H, 129G/550I, 129G/ 550I/562I, 129G/562I/606M/711K, 129T/180P/434H/562I/ 711K/789N, 129T/180P/606M/711K/789N, 129T/347R/ 562I, 129T/536L/539R/562I, 129T/539R/562/789N, 129T/ 550I/562I, 180P/532Y, 180P/550I/606M, 347R/531R/550I/ 711K, 347R/536L/539R/550I/711K/789N, 347R/536L/ 562I/606M/612A, 347R/550I/562I/606H, 434H/531R/ 539R/550I/562I/711K, 434H/550I, 531R/532Y/536L/539R/ 562I/711K/789N, 531R/532Y/536L/550I/562I/606M/ 789N, 531R/532Y/562I/606H/711K, 532Y/539R/550I, and 562I/711K, wherein the positions are numbered with reference to SEQ ID NO: 2064. In some embodiments, the polypeptide sequence of the engineered sucrose synthase comprises at least one mutation or mutation set at one or more positions selected from P57W/R71Q/E87H/N347R/ Y434H/L562I/R606H, P57W/R71Q/E129G/S531R/S532Y/ E536L/S539R/R606H, P57W/R71Q/E129T/D180P/ Y434H/E536L/L562I, P57W/R71Q/E129T/Y434H/S531R/ E536L/L562I, P57W/R71Q/L562I/R606M/R711K/A789N, P57W/R71Q/A789N, P57W/E87H/D180P/S531R/S532Y/ L562I/R606M/E612A/R711K, P57W/E87H/N347R/L562I, P57W/R90H/E129G/L562I, P57W/R90H/E129T/L562I/ R711K, P57W/L96Q/E129T/D180P/S531R/S532Y/Q550I/ L562I, P57W/E129G/S531R/S539R/L562I/A789N, P57W/ E129G/E536L/R606M/A789N, P57W/E129T/N347R/ S531R/S532Y/S539R/L562I/R711K/A747V, P57W/E129T/ N347R/E536L/Q550I/L562I/R711K/A789N, P57W/ E129T/N347R/Q550I/R711K, P57W/E129T/R606M, P57W/D180P/L562I, P57W/D180P/L562I/R606H/E612A, P57W/N347R/Y434H/S531R/S532Y/S539R/A789N, P57W/Y434H/Q550I/L562I/R606H/E612A/A789N, P57W/S531R/S532Y/E536L/L562I, P57W/L562I/R606M/ R711K, P57W/L562I/R711K, R71Q/E129T/D180P/N347R/ S531R/S539R/Q550I, R71Q/E129T/D180P/Y434H/ S532Y/E536L/S539R/R711K/A789N, R71Q/E129T/ S531R, R71Q/E129T/R606M, R71Q/N347R/S532Y/ Q550I/L562I/R711K, R71Q/N347R/E536L/L562I/E612A/ A789N, R71Q/E536L/S539R/L562I, E87H/G189D/S532Y/ E536L/L562I/R711K/A789N, E87H/N347R/S531R/ R606M/A789N, E87H/N347R/E536L/S539R/Q550I, R90H/E129T/S539R/Q550I/R606H, E129G/Q550I, E129G/Q550I/L562I, E129G/L562I/R606M/R711K, E129T/D180P/Y434H/L562I/R711K/A789N, E129T/ D180P/R606M/R711K/A789N, E129T/N347R/L562I, E129T/E536L/S539R/L562I, E129T/S539R/L562I/A789N, E129T/Q550I/L562I, D180P/S532Y, D180P/Q550I/ R606M, N347R/S531R/Q550I/R711K, N347R/E536L/ S539R/Q550I/R711K/A789N, N347R/E536L/L562I/ R606M/E612A, N347R/Q550I/L562I/R606H, Y434H/ S531R/S539R/Q550I/L562I/R711K, Y434H/Q550I/ S531R/S532Y/E536L/S539R/L562I/R711K/A789N, S531R/S532Y/E536L/Q550I/L562I/R606M/A789N, S531R/S532Y/L562I/R606H/R711K, S532Y/S539R/ Q550I, and L562I/R711K, wherein the positions are numbered with reference to SEQ ID NO: 2064. In some embodiments, the polypeptide sequence of the engineered sucrose synthase comprises at least one mutation or mutation set at one or more positions selected from 21, 25/112, 41, 89, 91, 112, 186, 200, 226, 259, 318, 330, 485, 487, 641, 674, 684, 688, 763, and 764, wherein the positions are numbered with reference to SEQ ID NO: 2064.

In some embodiments, the polypeptide sequence of the engineered sucrose synthase comprises at least one mutation or mutation set at one or more positions selected from 21Q, 25T/112W, 41K, 89L, 89M, 91C, 91G, 112Q, 112R, 186V, 200A, 226V, 259G, 318A, 330A, 485A, 485S, 487I, 487K, 487R, 487T, 487V, 641L, 674A, 684G, 684H, 684M, 684T, 688A, 688F, 688G, 688H, 688Q, 763L, and 764R, wherein the positions are numbered with reference to SEQ ID NO: 2064. In some embodiments, the polypeptide sequence of the engineered sucrose synthase comprises at least one mutation or mutation set at one or more positions selected from R21Q, A25T/G112W, A41K, V89L, V89M, I91C, I91G, G112Q, G112R, L186V, V200A, P226V, D259G, P318A, S330A, G485A, G485S, Q487I, Q487K, Q487R, Q487T, Q487V, V641L, S674A, F684G, F684H, F684M, F684T, L688A, L688F, L688G, L688H, L688Q, V763L, and L764R, wherein the positions are numbered with reference to SEQ ID NO: 2064. In some embodiments, the polypeptide sequence of the engineered sucrose synthase comprises a sequence at least 90% identical to any of SEQ ID NOS: 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, and 2502. In some embodiments, the polypeptide sequence of the engineered sucrose synthase comprises a sequence at least 95% identical to any of SEQ ID NOS: 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, and 2502. In some embodiments, the polypeptide sequence of the engineered sucrose synthase comprises any of SEQ ID NOS: 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, and 2502.

The present invention also provides engineered sucrose synthases, wherein the polypeptide sequence of the engineered sucrose synthases comprise at least one mutation or mutation set at one or more positions selected from 33/47/ 59/81/175/530/534/550/606, 33/58/59/81/130/480/530/534/ 550/652, 33/58/59/480/530/534/550, 33/58/154/480/534/ 550/603/606, 33/59/480/530/534/550/606, 33/79/81/175/ 530/534, 33/79/81/175/530/534/603, 33/79/154/480/530/ 534/550, 33/81/130/480/530/534/550, 33/81/175/530/534/

542/550/652, 33/130/530/534/550, 33/154/480/530/534/ 603/606, 33/154/534, 33/530/534/550, 58/59/79/175/480/ 534/550/652, 59/154/530/534/550, 79/81/480/530/534/550/ 603/606/652, 81/480/530/534/550, and 130/480/530/534/ 550/603/606, wherein the positions are numbered with reference to SEQ ID NO: 2432. In some embodiments, the polypeptide sequence of the engineered sucrose synthase comprises at least one mutation or mutation set at one or more positions selected from 33H/47P/59A/81L/175G/ 530F/534W/550I/606M, 33H/58M/59A/81G/130Y/480V/ 530F/534W/550I/652K, 33H/58M/59A/480P/530F/534W/ 550I, 33H/58M/154A/480P/534W/550I/603A/606M, 33H/ 59A/480P/530F/534W/550I/606M, 33H/79H/81G/175G/ 530F/534W, 33H/79H/81L/175G/530F/534W/603Q, 33H/ 79H/154A/480P/530F/534W/550I, 33H/81G/130Y/480V/ 530F/534W/550I, 33H/81I/175G/530F/534W/542W/550I/ 652R, 33H/130Y/530F/534W/550I, 33H/154A/480P/530F/ 534W/603Q/606M, 33H/154A/534W, 33H/530F/534W/ 550I, 58M/59A/79H/175G/480P/534W/550I/652R, 59A/ 154A/530F/534W/550I, 79H/81I/480P/530F/534W/550I/ 603E/606M/652R, 81G/480V/530F/534W/550I, and 130Y/ 480V/530F/534W/550I/603Q/606M, wherein the positions are numbered with reference to SEQ ID NO: 2432. In some embodiments, the polypeptide sequence of the engineered sucrose synthase comprises at least one mutation or mutation set at one or more positions selected from Q33H/L47P/ E59A/P81L/S175G/P530F/E534W/Q550I/R606M, Q33H/ L58M/E59A/P81G/D130Y/I480V/P530F/E534W/Q550I/ G652K, Q33H/L58M/E59A/I480P/P530F/E534W/Q550I, Q33H/L58M/H154A/I480P/E534W/Q550I/G603A/ R606M, Q33H/E59A/I480P/P530F/E534W/Q550I/R606M, Q33H/W79H/P81G/S175G/P530F/E534W, Q33H/W79H/ P81L/S175G/P530F/E534W/G603Q, Q33H/W79H/ H154A/I480P/P530F/E534W/Q550I, Q33H/P81G/D130Y/ I480V/P530F/E534W/Q550I, Q33H/P81I/S175G/P530F/ E534W/F542W/Q550I/G652R, Q33H/D130Y/P530F/ E534W/Q550I, Q33H/H154A/I480P/P530F/E534W/ G603Q/R606M, Q33H/H154A/E534W, Q33H/P530F/ E534W/Q550I, L58M/E59A/W79H/S175G/I480P/E534W/ Q550I/G652R, E59A/H154A/P530F/E534W/Q550I, W79H/P81I/I480P/P530F/E534W/Q550I/G603E/R606M/ G652R, P81G/I480V/P530F/E534W/Q550I, and D130Y/ I480V/P530F/E534W/Q550I/G603Q/R606M, wherein the positions are numbered with reference to SEQ ID NO: 2432. In some embodiments, the polypeptide sequence of the engineered sucrose synthase comprises at least one mutation or mutation set at one or more positions selected from 25, 42, 70, 75, 77, 106, 199, 265, 267, 380, 410, 561, 642, and 758, wherein the positions are numbered with reference to SEQ ID NO: 2432. In some embodiments, the polypeptide sequence of the engineered sucrose synthase comprises at least one mutation or mutation set at one or more positions selected from 25E, 25G, 25L, 42H, 42S, 42T, 70H, 70N, 70R, 70S, 70V, 75T, 75W, 77L, 77W, 106W, 199A, 265A, 265Q, 267I, 380T, 410S, 561I, 561V, 642V, 758Q, and 758R, wherein the positions are numbered with reference to SEQ ID NO: 2432. In some embodiments, the polypeptide sequence of the engineered sucrose synthase comprises at least one mutation or mutation set at one or more positions selected from A25E, A25G, A25L, D42H, D42S, D42T, F70H, F70N, F70R, F70S, F70V, M75T, M75W, F77L, F77W, Y106W, T199A, S265A, S265Q, V267I, A380T, T410S, L561I, L561V, A642V, G758Q, and G758R, wherein the positions are numbered with reference to SEQ ID NO: 2432. In some embodiments, the polypeptide sequence of the engineered sucrose synthase comprises a sequence at least 90% identical to any of SEQ ID NOS: 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, and 2594. In some embodiments, the polypeptide sequence of the engineered sucrose synthase comprises a sequence at least 95% identical to any of SEQ ID NOS: 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, and 2594. In some embodiments, the polypeptide sequence of the engineered sucrose synthase comprises any of SEQ ID NOS: 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, and 2594.

The present invention also provides engineered sucrose synthases, wherein the polypeptide sequence of the engineered sucrose synthases comprise at least one mutation or mutation set at one or more positions selected from 41, 41/71, 41/71/112, 41/71/112/259/485/487/684/688, 41/71/ 112/259/485/688, 41/71/259/485/532, 41/71/485, 41/71/ 485/532/684, 41/71/487, 41/71/487/532/684, 41/71/532, 41/71/532/684, 41/71/684, 41/84/259/485/487, 41/91/112/ 485, 41/91/112/485/487/532/684, 41/91/112/485/532/684, 41/91/485, 41/112, 41/112/259/485/487, 41/112/259/487/ 532/684, 41/112/485/684, 41/112/487/684, 41/112/532, 41/112/684/688, 41/259/485, 41/259/485/487, 41/259/485/ 487/532/684, 41/259/485/487/684/688, 41/259/532, 41/485, 41/485/487, 41/485/487/684/688, 41/485/532, 41/485/ 532/ 688, 41/485/684/688, 41/487/684, 41/532, 41/684, 41/684/ 688, 44/112/684/688, 71/112/259/485/487/684, 71/112/485/ 688, 71/485/684/688, 71/532, 71/684/688, 112, 112/259, 112/259/532/684/688, 112/259/684/688, 112/485/684, 112/ 485/684/688, 226/487/684/688, 259/485/487/684, 259/485/ 532, 259/487/684/688, 259/532, 485, 485/487, 485/487/532, 485/487/532/684, 485/487/684, 485/487/684/688, 485/532, 485/684, 485/684/688, 532, 532/684/688, 684, and 684/688, wherein the positions are numbered with reference to SEQ ID NO: 2510. In some embodiments, the polypeptide sequence of the engineered sucrose synthase comprises at least one mutation or mutation set at one or more positions selected from 41K, 41K/71Q, 41K/71Q/112Q, 41K/71Q/ 112Q/259G/485A/688Q, 41K/71Q/112W/259G/485S/ 487R/684H/688Q, 41K/71Q/259G/485A/532Y, 41K/71Q/ 485A, 41K/71Q/485A/532Y/684H, 41K/71Q/487R, 41K/ 71Q/487R/532Y/684H, 41K/71Q/532Y, 41K/71Q/532Y/ 684H, 41K/71Q/684H, 41K/84A/259G/485A/487I, 41K/ 91C/112Q/485S, 41K/91C/112Q/485S/487K/532Y/684H, 41K/91C/112Q/485S/532Y/684H, 41K/91C/485S, 41K/ 112Q/259G/485S/487R, 41K/112Q/259G/487R/532Y/ 684H, 41K/112Q/485S/684H, 41K/112Q/487I/684H, 41K/ 112Q/532Y, 41K/112Q/684H/688A, 41K/112W, 41K/259G/ 485A/487I, 41K/259G/485A/487R/532Y/684H, 41K/259G/ 485A/487R/684H/688A, 41K/259G/485S, 41K/259G/532Y, 41K/485A, 41K/485A/487K, 41K/485A/487R, 41K/485A/ 532Y, 41K/485A/532Y/688G, 41K/485S/487I/684M/688G, 41K/485S/684M/688A, 41K/487I/684M, 41K/487R/684M, 41K/532Y, 41K/684H, 41K/684M/688A, 44C/112W/684H/ 688A, 71Q/112Q/259G/485A/487R/684M, 71Q/112W/ 485S/688A, 71Q/485S/684M/688Q, 71Q/532Y, 71Q/684M/ 688A, 112Q, 112Q/259G/532Y/684M/688G, 112Q/259G/ 684M/688Q, 112Q/485S/684H, 112Q/485S/684H/688G, 112Q/485S/684M/688G, 112W, 112W/259G, 226V/487I/ 684M/688A, 259G/485S/487K/684H, 259G/485S/532Y, 259G/487I/684M/688G, 259G/532Y, 485A, 485A/487R, 485A/532Y, 485A/684H/688G, 485A/684M, 485S, 485S/ 487I/684H/688Q, 485S/487I/684M, 485S/487K/532Y, 485S/487R/532Y/684H, 485S/684M/688G, 532Y, 532Y/ 684H/688Q, 684H, and 684M/688Q, wherein the positions are numbered with reference to SEQ ID NO: 2510. In some embodiments, the polypeptide sequence of the engineered sucrose synthase comprises at least one mutation or mutation set at one or more positions selected from A41K, A41K/R71Q, A41K/R71Q/G112Q, A41K/R71Q/G112Q/ D259G/G485A/L688Q, A41K/R71Q/G112W/D259G/ G485S/Q487R/F684H/L688Q, A41K/R71Q/D259G/ G485A/S532Y, A41K/R71Q/G485A, A41K/R71Q/G485A/ S532Y/F684H, A41K/R71Q/Q487R, A41K/R71Q/Q487R/ S532Y/F684H, A41K/R71Q/S532Y, A41K/R71Q/S532Y/ F684H, A41K/R71Q/F684H, A41K/G84A/D259G/G485A/ Q487I, A41K/I91C/G112Q/G485S, A41K/I91C/G112Q/ G485S/Q487K/S532Y/F684H, A41K/I91C/G112Q/G485S/ S532Y/F684H, A41K/I91C/G485S, A41K/G112Q/D259G/ G485S/Q487R, A41K/G112Q/D259G/Q487R/S532Y/ F684H, A41K/G112Q/G485S/F684H, A41K/G112Q/ Q487I/F684H, A41K/G112Q/S532Y, A41K/G112Q/F684H/ L688A, A41K/G112W, A41K/D259G/G485A/Q487I, A41K/D259G/G485A/Q487R/S532Y/F684H, A41K/ D259G/G485A/Q487R/F684H/L688A, A41K/D259G/ G485S, A41K/D259G/S532Y, A41K/G485A, A41K/ G485A/Q487K, A41K/G485A/Q487R, A41K/G485A/ S532Y, A41K/G485A/S532Y/L688G, A41K/G485S/Q487I/ F684M/L688G, A41K/G485S/F684M/L688A, A41K/ Q487I/F684M, A41K/Q487R/F684M, A41K/S532Y, A41K/ F684H, A41K/F684M/L688A, R44C/G112W/F684H/ L688A, R71Q/G112Q/D259G/G485A/Q487R/F684M, R71Q/G112W/G485S/L688A, R71Q/G485S/F684M/ L688Q, R71Q/S532Y, R71Q/F684M/L688A, G112Q, G112Q/D259G/S532Y/F684M/L688G, G112Q/D259G/ F684M/L688Q, G112Q/G485S/F684H, G112Q/G485S/ F684H/L688G, G112Q/G485S/F684M/L688G, G112W, G112W/D259G, P226V/Q487I/F684M/L688A, D259G/ G485S/Q487K/F684H, D259G/G485S/S532Y, D259G/ Q487I/F684M/L688G, D259G/S532Y, G485A, G485A/ Q487R, G485A/S532Y, G485A/F684H/L688A, G485A/ F684M, G485S, G485S/Q487I/F684H/L688Q, G485S/ Q487I/F684M, G485S/Q487K/S532Y, G485S/Q487R/ S532Y/F684H, G485S/F684M/L688G, S532Y, S532Y/ F684H/L688Q, F684H, and F684M/L688Q, wherein the positions are numbered with reference to SEQ ID NO: 2510. In some embodiments, the polypeptide sequence of the engineered sucrose synthase comprises at least one mutation or mutation set at one or more positions selected from 7/12, 12, 27, 29, 44, 45, 47, 48, 51, 55, 72, 95, 100, 116, 136, 139, 176, 178, 198, 201, 205, 205/485, 207, 208, 280, 303, 317, 343, 358, 361, 440, 478, 611, 615, 630, 675, 724, 756, and 788, wherein the positions are numbered with reference to SEQ ID NO: 2510. In some embodiments, the polypeptide sequence of the engineered sucrose synthase comprises at least one mutation or mutation set at one or more positions selected from 7K/12L, 12C, 12N, 12Q, 12S, 12V, 27R, 29A, 29G, 29L, 29P, 44L, 44V, 45A, 45C, 45G, 45L, 45S, 45V, 47C, 47D, 47I, 47L, 47N, 47T, 47V, 48A, 48V, 51P, 51S, 55D, 55S, 72E, 95D, 95L, 95N, 95T, 95V, 100K, 100P, 100Q, 116A, 116F, 136A, 136F, 136K, 136N, 136P, 136Q, 139K, 176M, 176R, 176T, 176V, 178H, 198A, 198R, 201S, 205R/485S, 205S, 207K, 208K, 280G, 303V, 317I, 343A, 343N, 358P, 358S, 361A, 361L, 361T, 440R, 478H, 478I, 478Q, 611A, 615C, 615K, 615L, 615M, 630M, 675C, 724G, 724K, 724S, 756C, and 788K, wherein the positions are numbered with reference to SEQ ID NO: 2510. In some embodiments, the polypeptide sequence of the engineered sucrose synthase comprises at least one mutation or mutation set at one or more positions selected from Q7K/D12L, D12C, D12N, D12Q, D12S, D12V, Q27R, D29A, D29G, D29L, D29P, R44L, R44V, E45A, E45C, E45G, E45L, E45S, E45V, P47C, P47D, P47I, P47L, P47N, P47T, P47V, P48A, P48V, Y51P, Y51S, I55D, I55S, D72E, Q95D, Q95L, Q95N, Q95T, Q95V, E100K, E100P, E100Q, L116A, L116F, R136A, R136F, R136K, R136N, R136P, R136Q, R139K, L176M, L176R, L176T, L176V, R178H, Q198A, Q198R, Q201S, T205R/G485S, T205S, P207K, R208K, K280G, R303V, E317I, H343A, H343N, E358P, E358S, R361A, R361L, R361T, P440R, R478H, R478I, R478Q, R611A, R615C, R615K, R615L, R615M, L630M, S675C, H724G, H724K, H724S, V756C, and H788K, wherein the positions are numbered with reference to SEQ ID NO: 2510. In some embodiments, the polypeptide sequence of the engineered sucrose synthase comprises a sequence at least 90% identical to any of SEQ ID NOS: 7438, 7440, 7442, 7444, 7446, 7448, 7450, 7452, 7454, 7456, 7458, 7460, 7462, 7464, 7466, 7468, 7470, 7472, 7474, 7476, 7478, 7480, 7482, 7484, 7486, 7488, 7490, 7492, 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558, 7560, 7562, 7564, 7566, 7568, 7570, 7572, 7574, 7576, 7578, 7580, 7582, 7584, 7586, 7588, 7590, 7592, 7594, 7596, 7598, 7600, 7602, 7604, 7606, 7608, 7610, 7612, 7614, 7616, 7618, 7620, 7622, 7624, 7626, 7628, 7630, 7632, 7634, 7636, 7638, 7640, 7642, 7644, 7646, 7648, 7650, 7652, 7654, 7656, 7658, 7660, 7662, 7664, 7666, 7668, 7670, 7672, 7674, 7676, 7678, 7680, 7682, 7684, 7686, 7688, 7690, 7692, 7694, 7696, 7698, 7700, 7702, 7704, 7706, 7708, 7710, 7712, 7714, 7716, 7718, 7720, 7722, 7724, 7726, 7728, 7730, 7732, 7734, 7736, 7738, 7740, 7742, 7744, 7746, 7748, 7750, 7752, 7754, 7756, 7758, 7760, 7762, and 7764. In some embodiments, the polypeptide sequence of the engineered sucrose synthase comprises a sequence at least 95% identical to any of SEQ ID NOS: 7438, 7440, 7442, 7444, 7446, 7448, 7450, 7452, 7454, 7456, 7458, 7460, 7462, 7464, 7466, 7468, 7470, 7472, 7474, 7476, 7478, 7480, 7482, 7484, 7486, 7488, 7490, 7492, 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558, 7560, 7562, 7564, 7566, 7568, 7570, 7572, 7574, 7576, 7578, 7580, 7582, 7584, 7586, 7588, 7590, 7592, 7594, 7596, 7598, 7600, 7602, 7604, 7606, 7608, 7610, 7612, 7614, 7616, 7618, 7620, 7622, 7624, 7626, 7628, 7630, 7632, 7634, 7636, 7638, 7640, 7642, 7644, 7646, 7648, 7650, 7652, 7654, 7656, 7658, 7660, 7662, 7664, 7666, 7668, 7670, 7672, 7674, 7676, 7678, 7680, 7682, 7684, 7686, 7688, 7690, 7692, 7694, 7696, 7698, 7700, 7702, 7704, 7706, 7708, 7710, 7712, 7714, 7716, 7718, 7720, 7722, 7724, 7726, 7728, 7730, 7732, 7734, 7736, 7738, 7740, 7742, 7744, 7746, 7748, 7750, 7752, 7754, 7756, 7758, 7760, 7762, and 7764. In some embodiments, the polypeptide sequence of the engineered sucrose synthase comprises any of SEQ ID NOS: 7438, 7440, 7442, 7444, 7446, 7448, 7450, 7452, 7454, 7456, 7458, 7460, 7462, 7464, 7466, 7468, 7470, 7472, 7474, 7476, 7478, 7480, 7482, 7484, 7486, 7488, 7490, 7492, 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558, 7560, 7562, 7564, 7566, 7568, 7570, 7572, 7574, 7576, 7578, 7580, 7582, 7584, 7586, 7588, 7590, 7592, 7594, 7596, 7598, 7600, 7602, 7604, 7606, 7608, 7610, 7612, 7614, 7616, 7618, 7620, 7622, 7624, 7626, 7628, 7630, 7632, 7634, 7636, 7638, 7640, 7642, 7644, 7646, 7648, 7650, 7652, 7654, 7656, 7658, 7660, 7662, 7664, 7666, 7668, 7670, 7672, 7674, 7676, 7678, 7680, 7682, 7684, 7686, 7688, 7690, 7692, 7694, 7696, 7698, 7700, 7702, 7704, 7706, 7708, 7710, 7712, 7714, 7716, 7718, 7720, 7722, 7724, 7726, 7728, 7730, 7732, 7734, 7736, 7738, 7740, 7742, 7744, 7746, 7748, 7750, 7752, 7754, 7756, 7758, 7760, 7762, and 7764.

The present invention also provides engineered sucrose synthases, wherein the polypeptide sequence of the engineered sucrose synthases comprise at least one mutation or mutation set at one or more positions selected from 8/25/55/95/208/358/440/517/788, 12/45/47, 12/45/47/48/51/136/142/630, 12/45/47/51/136/139/630/758, 12/45/47/136/139/142/675/758, 12/45/51/136/139/630/675/756/758, 12/45/51/630/756, 12/48/51/136/139/758, 12/136/139/142/756/758, 12/136/142, 12/630/756, 25/29/208/440, 25/100/154/208/440/517/705/788, 25/517, 29/208/361/517/788, 42/198/199/480/532/539/561, 42/198/532/561, 42/198/532/561/724, 42/199/480/532/561, 42/259/480/561, 42/259/480/652, 42/480/561, 42/480/561/724, 42/561, 47/51/136/756/758, 55, 55/410/440/603/788, 55/517, 55/517/788, 70, 70/642, 77/176/487/615/642, 95/603, 106/199/539/561/652, 116, 136/139/142, 154/361/440/517/603/788, 176, 198/199/480/561, 198/199/480/561/724, 198/199/561/724, 198/480/561, 198/480/724, 199/532/539/561/652/724, 259/480, 267/611/642, 280/440/517, 380, 480/561/652, 480/561/652/724/764, 480/724, 517, 532/539/561, 532/561/724, 603, and 642, wherein the positions are numbered with reference to SEQ ID NO: 7506. In some embodiments, the polypeptide sequence of the engineered sucrose synthase comprises at least one mutation or mutation set at one or more positions selected from 8R/25E/55D/95T/208K/358S/440V/517P/788K, 12N/45A/47I/51P/136P/139K/630M/758R, 12N/45A/51P/136P/139K/630M/675C/756C/758Q, 12N/48A/51P/136Q/139K/758Q, 12N/136Q/142N, 12S/45A/51P/630M/756C, 12S/630M/756C, 12V/45A/47I/48A/51S/136Q/142N/630M, 12V/45A/47I/136Q/139K/142N/675C/758Q, 12V/45A/47L, 12V/136Q/139K/142N/756C/758Q, 25E/29P/208K/440R, 25E/100K/154A/208K/440R/517P/705M/788K, 25E/517P, 29P/208K/361T/517P/788K, 42T/198R/199A/480V/532Y/539R/561V, 42T/198R/532Y/561I/724K, 42T/198R/532Y/561V, 42T/199A/480V/532Y/561V, 42T/259G/480V/561V, 42T/259G/480V/652K, 42T/480P/561I, 42T/480V/561I/724K, 42T/561I, 47I/51S/136Q/756C/758Q, 55D, 55D/410/440R/603E/788K, 55D/517P, 55D/517P/788K, 70N, 70N/642V, 77L/176M/487K/615M/642V, 95T/603E, 106W/199A/539R/561I/652R, 116F, 136P/139K/142N, 154A/361T/440R/517P/603E/788K, 176T, 198R/199A/480P/561I, 198R/199A/480P/561V/724K, 198R/199A/561V/724G, 198R/480P/561I, 198R/480V/724K, 199A/532Y/539R/561I/652R/7245, 259G/480V, 2671/611Q/642V, 280G/440R/517P, 380T, 480V/561V/652R, 480V/561V/652R/724K/764R, 480V/724K, 517P, 532Y/539R/561V, 532Y/561I/724K, 603E, and 642V, wherein the positions are numbered with reference to SEQ ID NO: 7506. In some embodiments, the polypeptide sequence of the engineered sucrose synthase comprises at least one mutation or mutation set at one or more positions selected from Q8R/A25E/I55D/Q95T/R208K/E358S/P440V/A517P/H788K, D12N/E45A/P47I/Y51P/R136P/R139K/L630M/G758R, D12N/E45A/Y51P/R136P/R139K/ L630M/S675C/V756C/G758Q, D12N/P48A/Y51P/R136Q/R139K/G758Q, D12N/R136Q/S142N, D12S/E45A/Y51P/L630M/V756C, D12S/L630M/V756C, D12V/E45A/P47I/P48A/Y51S/R136Q/S142N/L630M, D12V/E45A/P47I/R136Q/R139K/S142N/S675C/G758Q, D12V/E45A/P47L, D12V/R136Q/R139K/S142N/V756C/G758Q, A25E/D29P/R208K/P440R, A25E/E100K/H154A/R208K/P440R/A517P/P705M/H788K, A25E/A517P, D29P/R208K/R361T/A517P/H788K, D42T/Q198R/T199A/I480V/S532Y/S539R/L561V, D42T/Q198R/S532Y/L561I/H724K, D42T/Q198R/S532Y/L561V, D42T/T199A/I480V/S532Y/L561V, D42T/D259G/I480V/L561V, D42T/D259G/I480V/G652K, D42T/I480P/L561I, D42T/I480V/L561I/H724K, D42T/L561I, P47I/Y51S/R136Q/V756C/G758Q, I55D, I55D/T410S/P440R/G603E/H788K, I55D/A517P, I55D/A517P/H788K, F70N, F70N/A642V, F77L/L176M/Q487K/R615M/A642V, Q95T/G603E, Y106W/T199A/S539R/L561I/G652R, L116F, R136P/R139K/S142N, H154A/R361T/P440R/A517P/G603E/H788K, L176T, Q198R/T199A/I480P/L561I, Q198R/T199A/I480P/L561V/H724K, Q198R/T199A/L561V/H724G, Q198R/I480P/L561I, Q198R/I480V/H724K, T199A/S532Y/S539R/L561I/G652R/H724S, D259G/I480V, V267I/R611Q/A642V, K280G/P440R/A517P, A380T, I480V/L561V/G652R, I480V/L561V/G652R/H724K/L764R, I480V/H724K, A517P, S532Y/S539R/L561V, S532Y/L561I/H724K, G603E, and A642V, wherein the positions are numbered with reference to SEQ ID NO: 7506. In some embodiments, the polypeptide sequence of the engineered sucrose synthase comprises a sequence at least 90% identical to any of SEQ ID NOS: 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442, 8444, 8446, 8448, 8450, 8452, 8454, 8456, 8458, 8460, 8462, 8464, 8466, 8468, 8470, 8472, 8474, 8476, 8478, and 8480. In some embodiments, the polypeptide sequence of the engineered sucrose synthase comprises a sequence at least 95% identical to any of SEQ ID NOS: 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442, 8444, 8446, 8448, 8450, 8452, 8454, 8456, 8458, 8460, 8462, 8464, 8466, 8468, 8470, 8472, 8474, 8476, 8478, and 8480. In some embodiments, the polypeptide sequence of the engineered sucrose synthase comprises any of SEQ ID NOS: 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442, 8444, 8446, 8448, 8450, 8452, 8454, 8456, 8458, 8460, 8462, 8464, 8466, 8468, 8470, 8472, 8474, 8476, 8478, and 8480.

The present invention also provides engineered sucrose synthases, wherein the polypeptide sequence of the engineered sucrose synthases comprise at least one mutation or mutation set at one or more positions selected from 12/45/95/136/139/199/517/630/756, 12/45/95/136/756, 12/45/136/139/199/517/603, 12/45/136/139/208/603/630/756, 12/45/136/139/517/603/756, 12/45/136/139/517/630/642/756, 12/45/136/139/517/756, 12/45/136/139/603/756, 12/45/136/139/642/756, 12/45/136/176/517/603/630/642, 12/45/136/208/517/630/756, 12/45/136/517/603/642/756, 789, 12/45/136/517/630/642/756, 12/45/136/603/756, 12/45/136/630/642, 12/45/139/176/208/517/603/630, 12/45/139/199/208/603, 12/45/139/517/756, 12/45/139/756, 12/45/176/603/630/642/756, 12/45/199/208/517/603/630/756, 12/45/208/517/603/642/756, 12/95/136/139/517/603/756, 12/95/139/517/630/756, 12/95/139/517/642, 12/95/139/630/642, 12/95/199/517/642, 12/95/517/630/756, 12/95/630/756, 12/136, 12/136/139/176/517/603/630, 12/136/139/176/517/603/756, 12/136/139/176/630/756, 12/136/139/176/642, 12/136/139/176/756, 12/136/139/199/208/517/603/756, 12/136/139/199/208/517/630/642/756, 12/136/139/208/517, 12/136/139/517, 12/136/139/517/603/630/642/756, 12/136/139/517/603/630/756, 12/136/139/517/603/756, 12/136/139/517/630, 12/136/139/517/630/642, 12/136/139/517/630/642/756, 12/136/139/517/756, 12/136/139/603/630, 12/136/139/603/630/642, 12/136/139/603/630/756, 12/136/139/603/642/756, 12/136/139/630, 12/136/139/630/642/756, 12/136/139/630/756, 12/136/139/642/756, 12/136/176/208/517/603/630/756, 12/136/176/517/642, 12/136/176/603/756, 12/136/199/208/517/603/642/756, 12/136/199/208/630/642, 12/136/199/517/756, 12/136/208, 12/136/208/603/642, 12/136/517/603/630/642, 12/136/517/603/630/756, 12/136/517/630, 12/136/517/630/642, 12/136/517/642, 12/136/517/642/756, 12/136/517/756, 12/136/603/630/642/756, 12/136/603/630/756, 12/136/603/642, 12/136/603/642/756, 12/136/603/756, 12/136/630, 12/136/630/756, 12/139/176/517/603/630/756, 12/139/176/630/756, 12/139/199/208/642, 12/139/199/517/630/756, 12/139/208/517, 12/139/208/642, 12/139/517/603/642/756, 12/139/517/630/642/756, 12/139/517/642, 12/139/603/642/756, 12/139/603/756, 12/139/630/642, 12/139/630/642/756, 12/139/630/756, 12/176/517/603/630, 12/176/517/630/642/756, 12/176/517/756, 12/176/603/630/756, 12/176/603/756, 12/199/208/517/642, 12/199/630/642/756, 12/199/642/756, 12/199/756, 12/208/517/603/623/630/642, 12/208/603/630/756, 12/208/630/756, 12/517/603/630/642/756, 12/517/603/630/756, 12/517/603/756, 12/517/630/642/756, 12/517/642/756, 12/603/630/756, 12/603/642/756, 12/603/756, 12/630/642/756, 12/630/756, 25/176/198/532/539, 116/142/198/434/440, 136/139/176/199/208/517/630/642, 136/139/176/517/630/642/756, 136/139/199/517/603/756, 136/139/208/517/630/756, 136/139/208/603/630/756, 136/139/517/603/630/642/756, 136/139/517/603/642/756, 136/139/517/603/756, 136/139/517/756, 136/139/603, 136/139/630/642/756, 136/517/756, 136/603/756, 136/630/642, 136/630/756, 136/642, 136/642/756, 136/756, 139/199/208/517/630/756, 139/199/517/642, 139/208/517/630/642/756, 139/517/603/756, 139/517/630/756, 139/642/756, 154/532/652/788, 199/517/603/630/756, 208/517/630/642/756, 517/603/630/642/756, 517/630/756, 603/630/756, and 603/756, wherein the positions are numbered with reference to SEQ ID NO: 8420. In some embodiments, the polypeptide sequence of the engineered sucrose synthase comprises at least one mutation or mutation set at one or more positions selected from 12N/45A/95T/136Q/139K/199A/517P/630M/756C, 12N/45A/136Q/139K/199A/517P/603E, 12N/45A/136Q/139K/517P/603E/756C, 12N/45A/136Q/139K/517P/630M/642V/756C, 12N/45A/136Q/139K/603E/756C, 12N/45A/136Q/139K/642V/756C, 12N/45A/136Q/208K/517P/630M/756C, 12N/45A/136Q/517P/630M/642V/756C, 12N/45A/136Q/603E/756C, 12N/45A/136Q/630M/642V, 12N/45A/139K/199A/208K/603E, 12N/45A/139K/517P/756C, 12N/45A/199A/208K/517P/603E/630M/756C, 12N/95T/136Q/139K/517P/603Q/756C, 12N/95T/139K/517P/642V, 12N/95T/139K/630M/642V, 12N/95T/199A/517P/642V, 12N/95T/517P/630M/756C, 12N/136Q, 12N/136Q/139K/176T/517P/603Q/756C, 12N/136Q/139K/176T/630M/756C, 12N/136Q/139K/176T/642V, 12N/136Q/139K/199A/208K/517P/630M/642V/756C, 12N/136Q/139K/517P, 12N/136Q/139K/517P/630M/642V, 12N/136Q/139K/517P/630M/642V/756C, 12N/136Q/139K/517P/756C, 12N/136Q/139K/603E/630M, 12N/136Q/139K/603Q/642V/756C, 12N/136Q/139K/630M, 12N/136Q/139K/642V/756C, 12N/136Q/176T/603Q/756C, 12N/136Q/199A/208K/517P/603E/642V/756C, 12N/136Q/199A/517P/756C, 12N/136Q/208K, 12N/136Q/517P/630M, 12N/136Q/603E/642V, 12N/136Q/603E/642V/756C, 12N/136Q/603Q/630M/756C, 12N/136Q/603Q/642V/756C, 12N/136Q/603Q/756C, 12N/139K/199A/208K/642V, 12N/139K/199A/517P/630M/756C, 12N/139K/208K/517P, 12N/139K/517P/603Q/642V/756C, 12N/139K/603E/642V/756C, 12N/139K/603Q/756C, 12N/139K/630M/642V, 12N/139K/630M/642V/756C, 12N/139K/630M/756C, 12N/176T/517P/603E/630M, 12N/176T/517P/630M/642V/756C, 12N/176T/517P/756C, 12N/199A/208K/517P/642V, 12N/199A/630M/642V/756C, 12N/199A/642V/756C, 12N/208K/517P/603E/623N/630M/642V, 12N/208K/630M/756C, 12N/517P/603E/756C, 12N/517P/603Q/630M/756C, 12N/517P/630M/642V/756C, 12N/603E/642V/756C, 12N/603Q/630M/756C, 12N/603Q/642V/756C, 12N/603Q/756C, 12N/630M/642V/756C, 12S/45A/95T/136Q/756C, 12S/45A/136Q/139K/208K/603E/630M/756C, 12S/45A/136Q/139K/517P/756C, 12S/45A/136Q/176T/517P/603E/630M/642V, 12S/45A/136Q/517P/603Q/642V/756C/789V, 12S/45A/139K/176T/208K/517P/603E/630M, 12S/45A/139K/517P/756C, 12S/45A/139K/756C, 12S/45A/176T/603Q/630M/642V/756C, 12S/45A/208K/517P/603E/642V/756C, 12S/95T/139K/517P/630M/756C, 12S/95T/630M/756C, 12S/136Q/139K/176T/517P/603Q/630M, 12S/136Q/139K/176T/756C, 12S/136Q/139K/199A/208K/517P/603E/756C, 12S/136Q/139K/208K/517P, 12S/136Q/139K/517P/603E/630M/642V/756C, 12S/136Q/139K/517P/603E/630M/756C, 12S/136Q/139K/517P/603E/756C, 12S/136Q/139K/517P/603Q/630M/642V/756C, 12S/136Q/139K/517P/603Q/756C, 12S/136Q/139K/517P/630M, 12S/136Q/139K/517P/630M/642V, 12S/136Q/139K/603Q/630M/642V, 12S/136Q/139K/603Q/630M/756C, 12S/136Q/139K/630M/642V/756C, 12S/136Q/139K/630M/756C, 12S/136Q/176T/208K/517P/603E/630M/756C, 12S/136Q/176T/517P/642V, 12S/136Q/199A/208K/630M/642V, 12S/136Q/208K/603Q/642V, 12S/136Q/517P/603Q/630M/642V, 12S/136Q/517P/603Q/630M/756C, 12S/136Q/517P/630M/642V, 12S/136Q/517P/642V, 12S/136Q/517P/642V/756C, 12S/136Q/517P/756C, 12S/136Q/603E/756C, 12S/136Q/603Q/630M/642V/756C, 12S/136Q/630M, 12S/136Q/630M/756C, 12S/139K/176T/517P/603Q/630M/756C, 12S/139K/176T/630M/756C, 12S/139K/208K/642V, 12S/139K/517P/630M/642V/756C, 12S/139K/517P/642V, 12S/139K/603Q/756C, 12S/176T/603E/756C, 12S/176T/603Q/630M/756C, 12S/199A/756C, 12S/208K/603Q/630M/756C, 12S/517P/603Q/630M/642V/756C, 12S/517P/630M/642V/756C, 12S/517P/642V/756C, 12S/603Q/630M/756C, 12S/630M/756C, 25E/176M/198R/532Y/539R, 116F/142N/198R/434H/440R, 136Q/139K/176T/199A/208K/517P/630M/642V, 136Q/139K/176T/517P/630M/642V/756C, 136Q/139K/199A/517P/603E/756C, 136Q/139K/208K/517P/630M/756C, 136Q/139K/208K/603Q/630M/756C, 136Q/139K/517P/603E/642V/756C, 136Q/139K/517P/603Q/630M/642V/756C, 136Q/139K/517P/603Q/756C, 136Q/139K/517P/756C, 136Q/139K/603Q, 136Q/139K/630M/642V/756C, 136Q/517P/756C, 136Q/603Q/756C, 136Q/630M/642V, 136Q/630M/756C, 136Q/642V, 136Q/642V/756C, 136Q/756C, 139K/199A/208K/517P/630M/642V/756C, 139K/199A/517P/642V, 139K/208K/517P/630M/642V/756C, 139K/517P/603Q/756C, 139K/517P/630M/756C, 139K/642V/756C, 154A/532Y/652R/788K, 199A/517P/603Q/630M/756C, 208K/517P/

630M/642V/756C, 517P/603E/630M/642V/756C, 517P/630M/756C, 603E/630M/756C, and 603Q/756C, wherein the positions are numbered with reference to SEQ ID NO: 8420. In some embodiments, the polypeptide sequence of the engineered sucrose synthase comprises at least one mutation or mutation set at one or more positions selected from D12N/E45A/Q95T/R136Q/R139K/T199A/A517P/L630M/V756C, D12N/E45A/R136Q/R139K/T199A/A517P/G603E, D12N/E45A/R136Q/R139K/A517P/G603E/V756C, D12N/E45A/R136Q/R139K/A517P/L630M/A642V/V756C, D12N/E45A/R136Q/R139K/G603E/V756C, D12N/E45A/R136Q/R139K/A642V/V756C, D12N/E45A/R136Q/R208K/A517P/L630M/V756C, D12N/E45A/R136Q/A517P/L630M/A642V/V756C, D12N/E45A/R136Q/G603E/V756C, D12N/E45A/R136Q/L630M/A642V, D12N/E45A/R139K/T199A/R208K/G603E, D12N/E45A/R139K/A517P/V756C, D12N/E45A/T199A/R208K/A517P/G603E/L630M/V756C, D12N/Q95T/R136Q/R139K/A517P/G603Q/V756C, D12N/Q95T/R139K/A517P/A642V, D12N/Q95T/R139K/L630M/A642V, D12N/Q95T/T199A/A517P/A642V, D12N/Q95T/A517P/L630M/V756C, D12N/R136Q, D12N/R136Q/R139K/L176T/A517P/G603Q/V756C, D12N/R136Q/R139K/L176T/L630M/V756C, D12N/R136Q/R139K/L176T/A642V, D12N/R136Q/R139K/T199A/R208K/A517P/L630M/A642V/V756C, D12N/R136Q/R139K/A517P, D12N/R136Q/R139K/A517P/L630M/A642V, D12N/R136Q/R139K/A517P/L630M/A642V/V756C, D12N/R136Q/R139K/A517P/V756C, D12N/R136Q/R139K/G603E/L630M, D12N/R136Q/R139K/G603Q/A642V/V756C, D12N/R136Q/R139K/L630M, D12N/R136Q/R139K/A642V/V756C, D12N/R136Q/L176T/G603Q/V756C, D12N/R136Q/T199A/R208K/A517P/G603E/A642V/V756C, D12N/R136Q/T199A/A517P/V756C, D12N/R136Q/R208K, D12N/R136Q/A517P/L630M, D12N/R136Q/G603E/A642V, D12N/R136Q/G603E/A642V/V756C, D12N/R136Q/G603Q/L630M/V756C, D12N/R136Q/G603Q/A642V/V756C, D12N/R136Q/G603Q/V756C, D12N/R139K/T199A/R208K/A642V, D12N/R139K/T199A/A517P/L630M/V756C, D12N/R139K/R208K/A517P, D12N/R139K/A517P/G603Q/A642V/V756C, D12N/R139K/G603E/A642V/V756C, D12N/R139K/G603Q/V756C, D12N/R139K/L630M/A642V, D12N/R139K/L630M/A642V/V756C, D12N/R139K/L630M/V756C, D12N/L176T/A517P/G603E/L630M, D12N/L176T/A517P/L630M/A642V/V756C, D12N/L176T/A517P/V756C, D12N/T199A/R208K/A517P/A642V, D12N/T199A/L630M/A642V/V756C, D12N/T199A/A642V/V756C, D12N/R208K/A517P/G603E/H623N/L630M/A642V, D12N/R208K/L630M/V756C, D12N/A517P/G603E/V756C, D12N/A517P/G603Q/L630M/V756C, D12N/A517P/L630M/A642V/V756C, D12N/G603E/A642V/V756C, D12N/G603Q/L630M/V756C, D12N/G603Q/A642V/V756C, D12N/G603Q/V756C, D12N/L630M/A642V/V756C, D12S/E45A/Q95T/R136Q/V756C, D12S/E45A/R136Q/R139K/R208K/G603E/L630M/V756C, D12S/E45A/R136Q/R139K/A517P/V756C, D12S/E45A/R136Q/L176T/A517P/G603E/L630M/A642V, D12S/E45A/R136Q/A517P/G603Q/A642V/V756C/A789V, D12S/E45A/R139K/L176T/R208K/A517P/G603E/L630M, D12S/E45A/R139K/A517P/V756C, D12S/E45A/R139K/V756C, D12S/E45A/L176T/G603Q/L630M/A642V/V756C, D12S/E45A/R208K/A517P/G603E/A642V/V756C, D12S/Q95T/R139K/A517P/L630M/V756C, D12S/Q95T/L630M/V756C, D12S/R136Q/R139K/L176T/A517P/G603Q/L630M, D12S/R136Q/

R139K/L176T/V756C, D12S/R136Q/R139K/T199A/R208K/A517P/G603E/V756C, D12S/R136Q/R139K/R208K/A517P, D12S/R136Q/R139K/A517P/G603E/L630M/A642V/V756C, D12S/R136Q/R139K/A517P/G603E/L630M/V756C, D12S/R136Q/R139K/A517P/G603E/V756C, D12S/R136Q/R139K/A517P/G603Q/L630M/A642V/V756C, D12S/R136Q/R139K/A517P/G603Q/V756C, D12S/R136Q/R139K/A517P/L630M, D12S/R136Q/R139K/A517P/L630M/A642V, D12S/R136Q/R139K/G603Q/L630M/A642V, D12S/R136Q/R139K/G603Q/L630M/V756C, D12S/R136Q/R139K/L630M/A642V/V756C, D12S/R136Q/R139K/L630M/V756C, D12S/R136Q/L176T/R208K/A517P/G603E/L630M/V756C, D12S/R136Q/L176T/A517P/A642V, D12S/R136Q/T199A/R208K/L630M/A642V, D12S/R136Q/R208K/G603Q/A642V, D12S/R136Q/A517P/G603Q/L630M/A642V, D12S/R136Q/A517P/G603Q/L630M/V756C, D12S/R136Q/A517P/L630M/A642V, D12S/R136Q/A517P/A642V, D12S/R136Q/A517P/A642V/V756C, D12S/R136Q/A517P/V756C, D12S/R136Q/G603E/V756C, D12S/R136Q/G603Q/L630M/A642V/V756C, D12S/R136Q/L630M, D12S/R136Q/L630M/V756C, D12S/R139K/L176T/A517P/G603Q/L630M/V756C, D12S/R139K/L176T/L630M/V756C, D12S/R139K/R208K/A642V, D12S/R139K/A517P/L630M/A642V/V756C, D12S/R139K/A517P/A642V, D12S/R139K/G603Q/V756C, D12S/L176T/G603E/V756C, D12S/L176T/G603Q/L630M/V756C, D12S/T199A/V756C, D12S/R208K/G603Q/L630M/V756C, D12S/A517P/G603Q/L630M/A642V/V756C, D12S/A517P/L630M/A642V/V756C, D12S/A517P/A642V/V756C, D12S/G603Q/L630M/V756C, D12S/L630M/V756C, A25E/L176M/Q198R/S532Y/S539R, L116F/S142N/Q198R/Y434H/P440R, R136Q/R139K/L176T/T199A/R208K/A517P/L630M/A642V, R136Q/R139K/L176T/A517P/L630M/A642V/V756C, R136Q/R139K/T199A/A517P/G603E/V756C, R136Q/R139K/R208K/A517P/L630M/V756C, R136Q/R139K/R208K/G603Q/L630M/V756C, R136Q/R139K/A517P/G603E/A642V/V756C, R136Q/R139K/A517P/G603Q/L630M/A642V/V756C, R136Q/R139K/A517P/G603Q/V756C, R136Q/R139K/A517P/V756C, R136Q/R139K/G603Q, R136Q/R139K/L630M/A642V/V756C, R136Q/A517P/V756C, R136Q/G603Q/V756C, R136Q/L630M/A642V, R136Q/L630M/V756C, R136Q/A642V, R136Q/A642V/V756C, R136Q/V756C, R139K/T199A/R208K/A517P/L630M/V756C, R139K/T199A/A517P/A642V, R139K/R208K/A517P/L630M/A642V/V756C, R139K/A517P/G603Q/V756C, R139K/A517P/L630M/V756C, R139K/A642V/V756C, H154A/S532Y/G652R/H788K, T199A/A517P/G603Q/L630M/V756C, R208K/A517P/L630M/A642V/V756C, A517P/G603E/L630M/A642V/V756C, A517P/L630M/V756C, G603E/L630M/V756C, and G603Q/V756C, wherein the positions are numbered with reference to SEQ ID NO: 8420. In some embodiments, the polypeptide sequence of the engineered sucrose synthase comprises a sequence that is at least 90% identical to any of SEQ ID NOS: 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, and 9106. In some embodiments, the polypeptide sequence of the engineered sucrose synthase comprises a sequence at least 95% identical to any of SEQ ID NOS: 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, and 9106. In some embodiments, the polypeptide sequence of the engineered sucrose synthase comprises any of SEQ ID NOS: 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, and 9106.

The present invention also provides engineered glycosyltransferases that are NDP-glycosyltransferases, wherein the engineered NDP-glycosyltransferase are NDP-glycosyltransferases selected from ADP-glucose-dependent glycosyltransferases (AGTs), CDP-glucose-dependent glycosyltransferases (CGTs), GDP-glucose-dependent glycosyltransferase (GGTs), TDP-glucose-dependent glycosyltransferases (TGTs), and IDP-glucose-dependent glycosyltransferase (IGTs). In some embodiments, the engineered NDP-glycosyltransferase is an ADP-glucose-dependent glycosyltransferase. In some embodiments, the engineered NDP-glycotransferase is not an UDP-glucose-dependent glycosyltransferase.

The present invention also provides engineered polynucleotides encoding at least one engineered glycosyltransferase polypeptide provided herein. In some embodiments, the engineered polynucleotide encoding at least one engineered glycosyltransferase provided herein comprises at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1289, 1291, 1293, 2595, 2597, 2599, 2601, 2603, 2605, 2607, 2609, 2611, 2613, 2615, 2617, 2619, 2621, 2623, 2625, 2627, 2629, 2631, 2633, 2635, 2637, 2639, 2641, 2643, 2645, 2647, 2649, 2651, 2653, 2655, 2657, 2659, 2661, 2663, 2665, 2667, 2669, 2671, 2673, 2675, 2677, 2679, 2681, 2683, 2685, 2687, 2689, 2691, 2693, 2695, 2697, 2699, 2701, 2703, 2705, 2707, 2709, 2711, 2713, 2715, 2717, 2719, 2721, 2723, 2725, 2727, 2729, 2731, 2733, 2735, 2737, 2739, 2741, 2743, 2745, 2747, 2749, 2751, 2753, 2755, 2757, 2759, 2761, 2763, 2765, 2767, 2769, 2771, 2773, 2775, 2777, 2779, 2781, 2783, 2785, 2787, 2789, 2791, 2793, 2795, 2797, 2799, 2801, 2803, 2805, 2807, 2809, 2811, 2813, 2815, 2817, 2819, 2821, 2823, 2825, 2827, 2829, 2831, 2833, 2835, 2837, 2839, 2841, 2843, 2845, 2847, 2849, 2851, 2823, 2855, 2857, 2859, 2861, 2863, 2865, 2867, 2869, 2871, 2873, 2875, 2877, 2879, 2881, 2883, 2885, 2887, 2889, 2891, 2893, 2895, 2897, 2899, 2901, 2903, 2905, 2907, 2909, 2911, 2913, 2915, 2917, 2919, 2921, 2923, 2925, 2927, 2829, 2931, 2933, 2935, 2937, 2939, 2941, 2943, 2945, 2947, 2949, 2951, 2953, 2955, 2957, 2959, 2961, 2963, 2965, 2967, 2969, 2971, 2973, 2975, 2977, 2979, 2981, 2983, 2985, 2987, 2989, 2991, 2993, 2995, 2997, 2999, 3001, 3003, 3005, 3007, 3009, 3011, 3013, 3015, 3017, 3019, 3021, 3023, 3025, 3027, 3029, 3031, 3033, 3035, 3037, 3039, 3041, 3043, 3045, 3047, 3049, 3051, 3053, 3055, 3057, 3059, 3061, 3063, 3065, 3067, 3069, 3071, 3073, 3075, 3077, 3079, 3081, 3083, 3085, 3087, 3089, 3091, 3093, 3095, 3097, 3099, 3101, 3103, 3105, 3107, 3109, 3111, 3113, 3115, 3117, 3119, 3121, 3123, 3125, 3127, 3129, 3131, 3133, 3135, 3137, 3139, 3141, 3143, 3145, 3147, 3149, 3151, 3153, 3155, 3157, 3159, 3161, 3163, 3165, 3167, 3169, 3171, 3173, 3175, 3177, 3179, 3181, 3183, 3185, 3187, 3189, 3191, 3193, 3195, 3197, 3199, 3201, 3203, 3205, 3207, 3209, 3211, 3213, 3215, 3217, 3219, 3221, 3223, 3225, 3227, 3229, 3231, 3233, 3235, 3237, 3239, 3241, 3243, 3245, 3247, 3249, 3251, 3253, 3255, 3257, 3259, 3261, 3263, 3265, 3267, 3269, 3271, 3273, 3275, 3277, 3279, 3281, 3283, 3285, 3287, 3289, 3291, 3293, 3295, 3297, 3299, 3301, 3303, 3305, 3307, 3309, 3311, 3313, 3315, 3317, 3319, 3321, 3323, 3325, 3327, 3329, 3331, 3333, 3335, 3337, 3339, 3341, 3343, 3345, 3347, 3349, 3351, 3353, 3355, 3357, 3359, 3361, 3363, 3365, 3367, 3369, 3371, 3373, 3375, 3377, 3379, 3381, 3383, 3385, 3387, 3389, 3391, 3393, 3395, 3397, 3399, 3401, 3403, 3405, 3407, 3409, 3411, 3413, 3415, 3417, 3419, 3421, 3423, 3425, 3427, 3429, 3431, 3433, 3435, 3437, 3439, 3441, 3443, 3445, 3447, 3449, 3451, 3453, 3455, 3457, 3459, 3461, 3463, 3465, 3467, 3469, 3471, 3473, 3475, 3477, 3479, 3481, 3483, 3485, 3487, 3489, 3491, 3493, 3495, 3497, 3499, 3501, 3503, 3505, 3507, 3509, 3511, 3513, 3515, 3517, 3519, 3521, 3523, 3525, 3527, 3529, 3531, 3533, 3535, 3537, 3539, 3541, 3543, 3545, 3547, 3549, 3551, 3553, 3555, 3557, 3559, 3561, 3563, 3565, 3567, 3569, 3571, 3573, 3575, 3577, 3579, 3581, 3583, 3585, 3587, 3589, 3591, 3593, 3595, 3597, 3599, 3601, 3603, 3605, 3607, 3609, 3611, 3613, 3615, 3617, 3619, 3621, 3623, 3625, 3627, 3629, 3631, 3633, 3635, 3637, 3639, 3641, 3643, 3645, 3647, 3649, 3651, 3653, 3655, 3657, 3659, 3661, 3663, 3665, 3667, 3669, 3671, 3673, 3675, 3677, 3679, 3681, 3683, 3685, 3687, 3689, 3691, 3693, 3695, 3697, 3699, 3791, 3703, 3705, 3707, 3709, 3711, 3713, 3715, 3717, 3719, 3721, 3723, 3725, 3727, 3729, 3731, 3733, 3735, 3737, 3739, 3741, 3743, 3745, 3747, 3749, 3751, 3753, 3755, 3757, 3759, 3761, 3763, 3765, 3767, 3769, 3771, 3773, 3775, 3777, 3779, 3781, 3783, 3785, 3787, 3789, 3791, 3793, 3795, 3797, 3799, 3801, 3803, 3805, 3807, 3809, 3811, 3813, 3815, 3817, 3819, 3821, 3823, 3825, 3827, 3829, 3831, 3833, 3835, 3837, 3839, 3841, 3843, 3845, 3847, 3849, 3851, 3853, 3855, 3857, 3859, 3861, 3863, 3865, 3867, 3869, 3871, 3873, 3875, 3877, 3879, 3881, 3883, 3885, 3887, 3889, 3891, 3893, 3895, 3897, 3899, 3901, 3903, 3905, 3907, 3909, 3911, 3913, 3915, 3917, 3919, 3921, 3923, 3925, 3927, 3929, 3931, 3933, 3935, 3937, 3939, 3941, 3943, 3945, 3947, 3949, 3951, 3953, 3955, 3957, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, 4021, 4023, 4025, 4027, 4029, 4031, 4033, 4035, 4037, 4039, 4041, 4043, 4045, 4047, 4049, 4051, 4053, 4055, 4057, 4059, 4061, 4063, 4065, 4067, 4069, 4071, 4073, 4075, 4077, 4079, 4081, 4083, 4085, 4087, 4089, 4091, 4093, 4095, 4097, 4099, 4101, 4103, 4105, 4107, 4109, 4111, 4113, 4115, 4117, 4119, 4121, 4123, 4125, 4127, 4129, 4131, 4133, 4135, 4137, 4139, 4141, 4143, 4145, 4147, 4149, 4151, 4153, 4155, 4157, 4159, 4161, 4163, 4165, 4167, 4169, 4171, 4173, 4175, 4177, 4179, 4181, 4183, 4185, 4187, 4189, 4191, 4193, 4195, 4197, 4199, 4201, 4203, 4205, 4207, 4209, 4211, 4213, 4215, 4217, 4219, 4221, 4223, 4225, 4227, 4229, 4231, 4233, 4235, 4237, 4239, 4241, 4243, 4245, 4247, 4249, 4251, 4253, 4255, 4257, 4259, 4261, 4263, 4265, 4267, 4269, 4271, 4273, 4275, 4277, 4279, 4281, 4283, 4285, 4287, 4289, 4291, 4293, 4295, 4297, 4299, 4301, 4303, 4305, 4307, 4309, 4311, 4313, 4315, 4317, 4319, 4321, 4323, 4325, 4327, 4329, 4331, 4333, 4335, 4337, 4339, 4341, 4343, 4345, 4347, 4349, 4351, 4353, 4355, 4357, 4359, 4361, 4363, 4365, 4367, 4369, 4371, 4373, 4375, 4377, 4379, 4381, 4383, 4385, 4387, 4389, 4391, 4393, 4395, 4397, 4399, 4401, 4403, 4405, 4407, 4409, 4411, 4413, 4415, 4417, 4419, 4421, 4423, 4425, 4427, 4429, 4431, 4433, 4435, 4437, 4439, 4441, 4443, 4445, 4447, 4449, 4451, 4453, 4455, 4457, 4459, 4461, 4463, 4465, 4467, 4469, 4471, 4473, 4475, 4477, 4479, 4481, 4483, 4485, 4487, 4489, 4491, 4493, 4495, 4497, 4499, 4501, 4503, 4505, 4507, 4509, 4511, 4513, 4515, 4517, 4519, 4521, 4523, 4525, 4527, 4529, 4531, 4533, 4535, 4537, 4539, 4541, 4543, 4545, 4547, 4549, 4551, 4553, 4555, 4557, 4559, 4561, 4563, 4565, 4567, 4569, 4571, 4573, 4575, 4577, 4579, 4581, 4583, 4585, 4587, 4589, 4591, 4593, 4595, 4597, 4599, 4601, 4603, 4605, 4607, 4609, 4611, 4613, 4615, 4617, 4619, 4621, 4623, 4625, 4627, 4629, 4631, 4633, 4635, 4637, 4639, 4641, 4643, 4645, 4647, 4649, 4651, 4653, 4655, 4657, 4659, 4661, 4663, 4665, 4667, 4669, 4671, 4673, 4675, 4677, 4679, 4681, 4683, 4685, 4687, 4689, 4691, 4693, 4695, 4697, 4699, 4701, 4703, 4705, 4707, 4709, 4711, 4713, 4715, 4717, 4719, 4721, 4723, 4725, 4727, 4729, 4731, 4733, 4735, 4737, 4739, 4741, 4743, 4745, 4747, 4749, 4751, 4753, 4755, 4757, 4759, 4761, 4763, 4765, 4767, 4769, 4771, 4773, 4775, 4777, 4779, 4781, 4783, 4785, 4787, 4789, 4791, 4793, 4795, 4797, 4799, 4801, 4803, 4805, 4807, 4809, 4811, 4813, 4815, 4817, 4819, 4821, 4823, 4825, 4827, 4829, 4831, 4833, 4835, 4837, 4839, 4841, 4843, 4845, 4847, 4849, 4851, 4853, 4855, 4857, 4859, 4861, 4863, 4865, 4867, 4869, 4871, 4873, 4875, 4877, 4879, 4881, 4883, 4885, 4887, 4889, 4891, 4893, 4895, 4897, 4899, 4901, 4903, 4905, 4907, 4909, 4911, 4913, 4915, 4917, 4919, 4921, 4923, 4925, 4927, 4929, 4931, 4933, 4935, 4937, 4939, 4941, 4943, 4945, 4947, 4949, 4951, 4953, 4955, 4957, 4959, 4961, 4963, 4965, 4967, 4969, 4971, 4973, 4975, 4977, 4979, 4981, 4983, 4985, 4987, 4989, 4991, 4993, 4995, 4997, 4999, 5001, 5003, 5005, 5007, 5009, 5011, 5013, 5015, 5017, 5019, 5021, 5023, 5025, 5027, 5029, 5031, 5033, 5035, 5037, 5039, 5041, 5043, 5045, 5047, 5059, 5051, 5053, 5055, 5057, 5059, 5061, 5063, 5065, 5067, 5069, 5071, 5073, 5075, 5077, 5079, 5081, 5083, 5085, 5087, 5089, 5091, 5093, 5095, 5097, 5099, 5101, 5103, 5105, 5107, 5109, 5111, 5113, 5115, 5117, 5119, 5121, 5123, 5125, 5127, 5129, 5131, 5133, 5135, 5137, 5139, 5141, 5143, 5145, 5147, 5149, 5151, 5153, 5155, 5157, 5159, 5161, 5163, 5165, 5167, 5169, 5171, 5173, 5175, 5177, 5179, 5181, 5183, 5185, 5187, 5189, 5191, 5193, 5195, 5197, 5199, 5201, 5203, 5205, 5207, 5209, 5211, 5213, 5215, 5217, 5219, 5221, 5223, 5225, 5227, 5229, 5231, 5233, 5235, 5237, 5239, 5241, 5243, 5245, 5247, 5249, 5251, 5253, 5255, 5257, 5259, 5261, 5263, 5265, 5267, 5269, 5271, 5273, 5275, 5277, 5279, 5281, 5283, 5285, 5287, 5289, 5291, 5293, 5295, 5297, 5299, 5301, 5303, 5305, 5307, 5309, 5311, 5313, 5315, 5317, 5319, 5321, 5323, 5325, 5327, 5329, 5331, 5333, 5335, 5337, 5339, 5341, 5343, 5345, 5347, 5349, 5351, 5353, 5355, 5357, 5359, 5361, 5363, 5365, 5367, 5369, 5371, 5373, 5375, 5377, 5379, 5381, 5383, 5385, 5387, 5389, 5391, 5393, 5395, 5397, 5399, 5401, 5403, 5405, 5407, 5409, 5411, 5413, 5415, 5417, 5419, 5421, 5423, 5425, 5427, 5429, 5431, 5433, 5435, 5437, 5439, 5441, 5443, 5445, 5447, 5449, 5451, 5453, 5455, 5457, 5459, 5461, 5463, 5465, 5467, 5469, 5471, 5473, 5475, 5477, 5479, 5481, 5483, 5485, 5487, 5489, 5491, 5493, 5495, 5497, 5499, 5501, 5503, 5505, 5507, 5509, 5511, 5513, 5515, 5517, 5519, 5521, 5523, 5525, 5527, 5529, 5531, 5533, 5535, 5537, 5539, 5541, 5543, 5545, 5547, 5549, 5551, 5553, 5555, 5557, 5559, 5561, 5563, 5565, 5567, 5569, 5571, 5573, 5575, 5577, 5579, 5581, 5583, 5585, 5587, 5589, 5591, 5593, 5595, 5597, 5599, 5601, 5603, 5605, 5607, 5609, 5611, 5613, 5615, 5617, 5619, 5621, 5623, 5625, 5627, 5629, 5631, 5633, 5635, 5637, 5639, 5641, 5643, 5645, 5647, 5649, 5651, 5653, 5655, 5657, 5659, 5661, 5663, 5665, 5667, 5669, 5671, 5673, 5675, 5677, 5679, 5681, 5683, 5685, 5687, 5689, 5691, 5693, 5695, 5697, 5699, 5701, 5703, 5705, 5707, 5709, 5711, 5713, 5715, 5717, 5719, 5721, 5723, 5725, 5727, 5729, 5731, 5733, 5735, 5737, 5739, 5741, 5743, 5745, 5747, 5749, 5751, 5753, 5755, 5757, 5759, 5761, 5763, 5765, 5767, 5769, 5771, 5773, 5775, 5777, 5779, 5781, 5783, 5785, 5787, 5789, 5791, 5793, 5795, 5797, 5799, 5801, 5803, 5805, 5807, 5809, 5811, 5813, 5815, 5817, 5819, 5821, 5823, 5825, 5827, 5829, 5831, 5833, 5835, 5837, 5839, 5841, 5843, 5845, 5847, 5849, 5851, 5853, 5855, 5857, 5859, 5861, 5863, 5865, 5867, 5869, 5871, 5873, 5875, 5877, 5879, 5881, 5883, 5885, 5887, 5889, 5891, 5893, 5895, 5897, 5899, 5901, 5903, 5905, 5907, 5909, 5911, 5913, 5915, 5917, 5919, 5921, 5923, 5925, 5927, 5929, 5931, 5933, 5935, 5937, 5939, 5941, 5943, 5945, 5947, 5949, 5951, 5953, 5955, 5957, 5959, 5961, 5963, 5965, 5967, 5969, 5971, 5973, 5975, 5977, 5979, 5981, 5983, 5985, 5987, 5989, 5991, 5993, 5995, 5997, 5999, 6001, 6003, 6005, 6007, 6009, 6011, 6013, 6015, 6017, 6019, 6021, 6023, 6025, 6027, 6029, 6031, 6033, 6035, 6037, 6039, 6041, 6043, 6045, 6047, 6049, 6051, 6053, 6055, 6057, 6059, 6061, 6063, 6065, 6067, 6069, 6071, 6073, 6075, 6077, 6079, 6081, 6083, 6085, 6087, 6089, 6091, 6093, 6095, 6097, 6099, 6101, 6103, 6105, 6107, 6109, 6111, 6113, 6115, 6117, 6119, 6121, 6123, 6125, 6127, 6129, 6131, 6133, 6135, 6137, 6139, 6141, 6143, 6145, 6147, 6149, 6151, 6153, 6155, 6157, 6159, 6161, 6163, 6165, 6167, 6169, 6171, 6173, 6175, 6177, 6179, 6181, 6183, 6185, 6187, 6189, 6191, 6193, 6195, 6197, 6199, 6201, 6203, 6205, 6207, 6209, 6211, 6213, 6215, 6217, 6219, 6221, 6223, 6225, 6227, 6229, 6231, 6233, 6235, 6237, 6239, 6241, 6243, 6245, 6247, 6249, 6251, 6253, 6255, 6257, 6259, 6261, 6263, 6265, 6267, 6269, 6271, 6273, 6275, 6277, 6279, 6281, 6283, 6285, 6287, 6289, 6291, 6293, 6295, 6297, 6299, 6301, 6303, 6305, 6307, 6309, 6311, 6313, 6315, 6317, 6319, 6321, 6323, 6325, 6327, 6329, 6331, 6333, 6335, 6337, 6339, 6341, 6343, 6345, 6347, 6349, 6351, 6353, 6355, 6357, 6359, 6361, 6363, 6365, 6367, 6369, 6371, 6373, 6375, 6377, 6379, 6381, 6383, 6385, 6387, 6389, 6391, 6393, 6395, 6397, 6399, 6401, 6403, 6405, 6407, 6409, 6411, 6413, 6415, 6417, 6419, 6421, 6423, 6425, 6427, 6429, 6431, 6433, 6435, 6437, 6439, 6441, 6443, 6445, 6447, 6449, 6451, 6453, 6455, 6457, 6459, 6461, 6463, 6465, 6467, 6469, 6471, 6473, 6475, 6477, 6479, 6481, 6483, 6485, 6487, 6489, 6491, 6493, 6495, 6497, 6499, 6501, 6503, 6505, 6507, 6509, 6511, 6513, 6515, 6517, 6519, 6521, 6523, 6525, 6527, 6529, 6531, 6533, 6535, 6537, 6539, 6541, 6543, 6545, 6547, 6549, 6551, 6553, 6555, 6557, 6559, 6561, 6563, 6565, 6567, 6569, 6571, 6573, 6575, 6577, 6579, 6581, 6583, 6585, 6587, 6589, 6591, 6593, 6595, 6597, 6599, 6601, 6603, 6605, 6607, 6609, 6611, 6613, 6615, 6617, 6619, 6621, 6623, 6625, 6627, 6629, 6631, 6633, 6635, 6637, 6639, 6641, 6643, 6645, 6647, 6649, 6651, 6653, 6655, 6657, 6659, 6661, 6663, 6665, 6667, 6669, 6671, 6673, 6675, 6677, 6679, 6681, 6683, 6685, 6687, 6689, 6691, 6693, 6695, 6697, 6699, 6701, 6703, 6705, 6707, 6709, 6711, 6713, 6715, 6717, 6719, 6721, 6723, 6725, 6727, 6729, 6731, 6733, 6735, 6737, 6739, 6741, 6743, 6745, 6747, 6749, 6751, 6753, 6755, 6757, 6759, 6761, 6763, 6765, 6767, 6769, 6771, 6773, 6775, 6777, 6779, 6781, 6783, 6785, 6787, 6789, 6791, 6793, 6795, 6797, 6799, 6801, 6803, 6805, 6807, 6809, 6811, 6813, 6815, 6817, 6819, 6821, 6823, 6825, 6827, 6829, 6831, 6833, 6835, 6837, 6839, 6841, 6843, 6845, 6847, 6849, 6851, 6853, 6855, 6857, 6859, 6861, 6863, 6865, 6867, 6869, 6871, 6873, 6875, 6877, 6879, 6881, 6883, 6885, 6887, 6889, 6891, 6893, 6895, 6897, 6899, 6901, 6903, 6905, 6907, 6909, 6911, 6913, 6915, 6917, 6919, 6921, 6923, 6925, 6927, 6929, 6931, 6933, 6935, 6937, 6939, 6941, 6943, 6945, 6947, 6949, 6951, 6953, 6955, 6957, 6959, 6961, 6963, 6965, 6967, 6969, 6971, 6973, 6975, 6977, 6979, 6981, 6983, 6985, 6987, 6989, 6991, 6993, 6995, 6997, 6999, 7001, 7003, 7005, 7007, 7009, 7011, 7013, 7015, 7017, 7019, 7021, 7023, 7025, 7027, 7029, 7031, 7033, 7035, 7037, 7039, 7041, 7043, 7045, 7047, 7049, 7051, 7053, 7055, 7057, 7059, 7061, 7063, 7065, 7067, 7069, 7071, 7073, 7075, 7077, 7079, 7081, 7083, 7085, 7087, 7089, 7091, 7093, 7095, 7097, 7099, 7101, 7103, 7105, 7107, 7109, 7111, 7113, 7115, 7117, 7119, 7121, 7123, 7125, 7127, 7129, 7131, 7133, 7135, 7137, 7139, 7141, 7143, 7145, 7147, 7149, 7151, 7153, 7155, 7157, 7159, 7161, 7163, 7165, 7167, 7169, 7171, 7173, 7175, 7177, 7179, 7181, 7183, 7185, 7187, 7189, 7191, 7193, 7195, 7197, 7199, 7201, 7203, 7205, 7207, 7209, 7211, 7213, 7215, 7217, 7219, 7221, 7223, 7225, 7227, 7229, 7231, 7233, 7235, 7237, 7239, 7241, 7243, 7245, 7247, 7249, 7251, 7253, 7255, 7257, 7259, 7261, 7263, 7265, 7267, 7269, 7271, 7273, 7275, 7277, 7279, 7281, 7283, 7285, 7287, 7289, 7291, 7293, 7295, 7297, 7299, 7301, 7303, 7305, 7307, 7309, 7311, 7313, 7315, 7317, 7319, 7321, 7323, 7325, 7327, 7329, 7331, 7333, 7335, 7337, 7339, 7341, 7343, 7345, 7347, 7349, 7351, 7353, 7355, 7357, 7359, 7361, 7363, 7365, 7367, 7369, 7371, 7373, 7375, 7377, 7379, 7381, 7383, 7385, 7387, 7389, 7391, 7393, 7395, 7397, 7399, 7401, 7403, 7405, 7407, 7409, 7411, 7413, 7415, 7417, 7419, 7421, 7423, 7425, 7427, 7429, 7431, 7433, 7435, 7765, 7767, 7769, 7771, 7773, 7775, 7777, 7779, 7781, 7783, 7785, 7787, 7789, 7791, 7793, 7795, 7797, 7799, 7811, 7813, 7815, 7817, 7819, 7821, 7823, 7825, 7827, 7829, 7831, 7833, 7835, 7837, 7839, 7841, 7843, 7845, 7847, 7849, 7851, 7853, 7855, 7857, 7859, 7861, 7863, 7865, 7867, 7869, 7871, 7873, 7875, 7877, 7879, 7881, 7883, 7885, 7887, 7889, 7891, 7893, 7895, 7897, 7899, 7901, 7903, 7905, 7907, 7909, 7911, 7913, 7915, 7917, 7919, 7921, 7923, 7925, 7927, 7929, 7931, 7933, 7935, 7937, 7939, 7941, 7943, 7945, 7947, 7949, 7951, 7953, 7955, 7957, 7959, 7961, 7963, 7965, 7967, 7969, 7971, 7973, 7975, 7977, 7979, 7981, 7983, 7985, 7987, 7989, 7991, 7993, 7995, 7997, 7999, 8001, 8003, 8005, 8007, 8009, 8011, 8013, 8015, 8017, 8019, 8021, 8023, 8025, 8027, 8029, 8031, 8033, 8035, 8037, 8039, 8041, 8043, 8045, 8047, 8049, 8051, 8053, 8055, 8057, 8059, 8061, 8063, 8065, 8067, 8069, 8071, 8073, 8075, 8077, 8079, 8081, 8083, 8085, 8087, 8089, 8091, 8093, 8095, 8097, 8099, 8101, 8103, 8105, 8107, 8109, 8111, 8113, 8115, 8117, 8119, 8121, 8123, 8125, 8127, 8129, 8131, 8133, 8135, 8137, 8139, 8141, 8143, 8145, 8147, 8149, 8151, 8153, 8155, 8157, 8159, 8161, 8163, 8165, 8167, 8169, 8171, 8173, 8175, 8177, 8179, 8181, 8183, 8185, 8187, 8189, 8191, 8193, 8195, 8197, 8199, 8201, 8203, 8205, 8207, 8209, 8211, 8213, 8215, 8217, 8219, 8221, 8223, 8225, 8227, 8229, 8231, 8233, 8235, 8237, 8239, 8241, 8243, 8245, 8247, 8249, 8251, 8253, 8255, 8257, 8259, 8261, 8263, 8265, 8267, 8269, 8271, 8273, 8275, 8277, 8279, 8281, 8283, 8285, 8287, 8289, 8291, 8293, 8295, 8297, 8299, 8301, 8303, 8305, 8307, 8309, 8311, 8313, 8315, 8317, 8319, 8321, 8323, 8325, 8327, 8329, 8331, 8333, 8335, 8337, 8339, 8341, 8343, 8345, 8347, 8349, 8351, 8353, 8355, 8357, 8359, 8361, 8363, 8365, 8367, 8481, 8483, 8485, 8487, 8489, 8491, 8493, 8495, 8497, 8489, 8501, 8503, 8505, 8507, 8509, 8511, 8513, 8515, 8517, 8519, 8521, 8523, 8525, 8527, 8529, 8531, 8533, 8535, 8537, 8539, 8541, 8543, 8545, 8547, 8549, 8551, 8553, 8555, 8557, 8559, 8561, 8563, 8565, 8567, 8569, 8571, 8573, 8575, 8577, 8579, 8581, 8583, 8585, 8587, 8589, 8591, 8593, 8595, 8597, 8599, 8601, 8603, 8605, 8607, 8609, 8611, 8613, 8615, 8617, 8619, 8621, 8623, 8625, 8627, 8629, 8631, 8633, 8635, 8637, 8639, 8641, 8643, 8645, 8647, 8649, 8651, 8653, 8655, 8657, 8659, 8661, 8663, 8665, 8667, 8669, 8671, 8673, 8675, 8677, 8679, 8681, 8683, 8685, 8687, 8689, 8691, 8693, 8695, 8697, 8699, 8701, 8703, 8705, 8707, 8709, 8711, 8713, 8715, 8717, 8719, 8721, 8723, 8725, 8727, 8729, 8731, 8733, 8735, 8737, 8739, 8741, 8743, 8745, 8747, 8749, 8751, 8753, 8755, 8757, 8759, 8761, 8763, 8765, 8767, 8769, 8771, 8773, 8775, 8777, 8779, 8781, 8783, 8785, 8787, 8789, 8791, 8793, 8795, 9107, 9109, 9111, 9113, 9115, 9117, 9119, 9121, 9123, 9125, 9127, 9129, 9131, 9133, 9135, 9137, 9139, 9141, 9143, 9145, 9147, 9149, 9151, 9153, 9155, 9157, 9159, 9161, 9163, 9165, 9167, 9169, 9171, 9173, 9175, 9177, 9179, 9181, 9183, 9185, 9187, 9189, 9191, 9193, 9195, 9197, 9199, 9201, 9203, 9205, 9207, 9209, 9211, 9213, 9215, 9217, 9219, 9221, 9223, 9225, 9227, 9229, 9231, 9233, 9235, 9237, and/or 9239.

The present invention also provides engineered polynucleotides encoding at least one engineered sucrose synthase polypeptide provided herein. In some embodiments, the engineered polynucleotide encoding at least one engineered sucrose synthase provided herein comprises at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1847, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219, 2221, 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2413, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543, 2545, 2547, 2549, 2551, 2553, 2555, 2557, 2559, 2561, 2563, 2565, 2567, 2569, 2571, 2573, 2575, 2577, 2579, 2581, 2583, 2585, 2587, 2589, 2591, 2593, 7437, 7439, 7441, 7443, 7445, 7447, 7449, 7451, 7453, 7455, 7457, 7459, 7461, 7463, 7465, 7467, 7469, 7471, 7473, 7475, 7477, 7479, 7481, 7483, 7485, 7487, 7489, 7491, 7493, 7495, 7497, 7499, 7501, 7503, 7505, 7507, 7509, 7511, 7513, 7515, 7517, 7519, 7521, 7523, 7525, 7527, 7529, 7531, 7533, 7535, 7537, 7539, 7541, 7543, 7545, 7547, 7549, 7551, 7553, 7555, 7557, 7559, 7561, 7563, 7565, 7567, 7569, 7571, 7573, 7575, 7577, 7579, 7581, 7583, 7585, 7587, 7589, 7591, 7593, 7595, 7597, 7599, 7601, 7603, 7605, 7607, 7609, 7611, 7613, 7615, 7617, 7619, 7621, 7623, 7625, 7627, 7629, 7631, 7633, 7635, 7637, 7639, 7641, 7643, 7645, 7647, 7649, 7651, 7653, 7655, 7657, 7659, 7661, 7663, 7665, 7667, 7669, 7671, 7673, 7675, 7677, 7679, 7681, 7683, 7685, 7687, 7689, 7691, 7693, 7695, 7697, 7699, 7701, 7703, 7705, 7707, 7709, 7711, 7713, 7715, 7717, 7719, 7721, 7723, 7725, 7727, 7729, 7731, 7733, 7735, 7737, 7739, 7741, 7743, 7745, 7747, 7749, 7751, 7753, 7755, 7757, 7759, 7761, 7763, 8369, 8371, 8373, 8375, 8377, 8379, 8381, 8383, 8385, 8387, 8389, 8391, 8393, 8395, 8397, 8399, 8401, 8403, 8405, 8407, 8409, 8411, 8413, 8415, 8417, 8419, 8421, 8423, 8425, 8427, 8429, 8431, 8433, 8435, 8437, 8439, 8441, 8443, 8445, 8447, 8449, 8451, 8453, 8455, 8457, 8459, 8461, 8463, 8465, 8467, 8469, 8471, 8473, 8475, 8477, 8479, 8797, 8799, 8801, 8803, 8805, 8807, 8809, 8811, 8813, 8815, 8817, 8819, 8821, 8823, 8825, 8827, 8829, 8831, 8833, 8835, 8837, 8839, 8841, 8843, 8845, 8847, 8849, 8851, 8853, 8855, 8857, 8859, 8861, 8863, 8865, 8867, 8869, 8871, 8873, 8875, 8877, 8879, 8881, 8883, 8885, 8887, 8889, 8891, 8893, 8895, 8897, 8899, 8901, 8903, 8905, 8907, 8909, 8911, 8913, 8915, 8917, 8919, 8921, 8923, 8925, 8927, 8929, 8931, 8933, 8935, 8937, 8939, 8941, 8943, 8945, 8947, 8949, 8951, 8953, 8955, 8957, 8959, 8961, 8963, 8965, 8967, 8969, 8971, 8973, 8975, 8977, 8979, 8981, 8983, 8985, 8987, 8989, 8991, 8993, 8995, 8997, 8999, 9001, 9003, 9005, 9007, 9009, 9011, 9013, 9015, 9017, 9019, 9021, 9023, 9025, 9027, 9029, 9031, 9033, 9035, 9037, 9039, 9041, 9043, 9045, 9047, 9049, 9051, 9053, 9055, 9057, 9059, 9061, 9063, 9065, 9067, 9069, 9071, 9073, 9075, 9077, 9079, 9081, 9083, 9085, 9087, 9089, 9091, 9093, 9095, 9097, 9099, 9101, 9103, and/or 9105.

The present invention also provides vectors comprising at least one engineered polynucleotide provided herein. In some embodiments, the vectors further comprise at least one control sequence.

The present invention also provides host cells comprising at least one engineered polypeptide provided herein. In some embodiments, the host cells comprise at least one vector provided herein. In some embodiments, the host cell is selected from eukaryotic and prokaryotic organisms. In some additional embodiments, the host cell is *E. coli*.

The present invention also provides methods for producing at least one engineered glycosyltransferase variant provided herein, comprising culturing the host cell provided herein, under conditions such that the engineered glycosyltransferase variant is produced by the host cell. In some embodiments, the methods further comprise the step of recovering the engineered glycosyltransferase variant.

The present invention also provides compositions comprising at least one engineered glycosyltransferase variant and/or sucrose synthase variant provided herein. In some embodiments, the compositions comprise at least one engineered glycosyltransferase variant provided herein.

The present invention also provides methods for producing at least one engineered sucrose synthase variant provided herein, comprising culturing the host cell provided herein, under conditions such that the engineered sucrose synthase variant is produced by the host cell. In some embodiments, the methods further comprise the step of recovering the engineered sucrose synthase variant. In some embodiments, the compositions comprise at least one engineered sucrose synthase variant provided herein.

The present invention also provides methods for glycosylation of a substrate comprising: providing at least one substrate, at least one engineered glycosyl transferase selected from the even numbered sequences provided herein; contacting the substrate with the glycosyltransferase under conditions such that the substrate is glycosylated to produce at least one glycosylated product. In some embodiments, the substrate comprises at least one steviol glycoside. In some embodiments, the glycosylated product comprises at least one mono-glycosylated and/or polyglycosylated product. It is not intended that the present invention be limited to any limitations regarding the extent of glycosylation of the product (e.g., diglycosylated, triglycosylated, and products with higher glycosylation levels find use in the present invention).

The present invention provides methods for producing rebaudioside M, comprising providing a rebaudioside D and/or rebaudioside I substrate, NDP-glucose, and a least one engineered glycosyltransferase provided herein, combining the rebaudioside D and rebaudioside I substrate, NDP-glucose, and the glycosyltransferase under conditions such that rebaudioside M is produced. In some additional embodiments, the present invention provides methods for producing rebaudioside M, comprising providing a rebaudioside D substrate, NDP-glucose, and a least one engineered glycosyltransferase provided herein, combining the rebaudioside D substrate, NDP-glucose, and glycosyltransferase under conditions such that rebaudioside M is produced. In some further embodiments, the present invention provides methods for producing rebaudioside M, comprising providing a rebaudioside I substrate, NDP-glucose, and a least one engineered glycosyltransferase provided herein, combining the rebaudioside I substrate, NDP-glucose, and glycosyltransferase under conditions such that rebaudioside M is produced. In some of the present embodiments, the NDP-glucose is selected from ADP-glucose, CDP-glucose, TDP-glucose, GDP-glucose, and/or IDT-glucose. In some additional embodiments, the NDP-glucose is not UDP-glucose.

The present invention provides methods for producing rebaudioside A and/or rebaudioside I, comprising providing a stevioside substrate, NDP-glucose, and at least one engineered glycosyltransferase provided herein, combining the stevioside substrate, NDP-glucose, and glycosyltransferase under conditions such that rebaudioside A and/or rebaudioside I is produced. In some embodiments, the present invention provides methods for producing rebaudioside A, comprising providing a stevioside substrate, NDP-glucose, and at least one engineered glycosyltransferase provided herein, combining the stevioside substrate, NDP-glucose, and glycosyltransferase under conditions such that rebaudioside A is produced. In some additional embodiments, the present invention provides methods for producing rebaudioside I, comprising providing a stevioside substrate, NDP-glucose, and at least one engineered glycosyltransferase provided herein, combining the stevioside substrate, NDP-glucose, and glycosyltransferase under conditions such that rebaudioside I is produced. In some of the present embodiments, the NDP-glucose is selected from ADP-glucose, CDP-glucose, TDP-glucose, GDP-glucose, and/or IDT-glucose. In some additional embodiments, the NDP-glucose is not UDP-glucose.

The present invention also provides methods for producing rebaudioside D, comprising providing a stevioside substrate, NDP-glucose, and at least one engineered glycosyltransferase provided herein, combining the stevioside substrate, NDP-glucose, and glycosyltransferase under conditions such that rebaudioside D is produced. In some of the present embodiments, the NDP-glucose is selected from ADP-glucose, CDP-glucose, TDP-glucose, GDP-glucose, and/or IDT-glucose. In some additional embodiments, the NDP-glucose is not UDP-glucose.

The present invention also provides methods for producing rebaudioside M comprising providing a rebaudioside D and/or rebaudioside I substrate, ADP-glucose, and at least one engineered glycosyltransferase provided herein, combining the rebaudioside D and/or rebaudioside I substrate, ADP-glucose, and glycosyltransferase under conditions such that rebaudioside M is produced. In some embodiments, the present invention provides methods for producing rebaudioside M comprising providing a rebaudioside D substrate, ADP-glucose, and at least one engineered glycosyltransferase of provided herein, combining the rebaudioside D substrate, ADP-glucose, and glycosyltransferase under conditions such that rebaudioside M is produced. In some additional embodiments, the present invention provides methods for producing rebaudioside M comprising providing a rebaudioside I substrate, ADP-glucose, and at least one engineered glycosyltransferase provided herein, combining the rebaudioside I substrate, ADP-glucose, and glycosyltransferase under conditions such that rebaudioside M is produced. In some of the present embodiments, the engineered glycosyltransferase comprises an ADP-glycosyltransferase.

The present invention also provides methods for producing rebaudioside A and/or rebaudioside I, comprising providing a stevioside substrate, ADP-glucose, and at least one engineered glycosyltransferase provided herein, combining the stevioside substrate, ADP-glucose, and glycosyltransferase under conditions such that rebaudioside A and/or rebaudioside I is produced. In some embodiments, the present invention provides methods for producing rebaudioside A, comprising providing a stevioside substrate, ADP-glucose, and at least one engineered glycosyltransferase provided herein, combining the stevioside substrate, ADP-glucose, and glycosyltransferase under conditions such that rebaudioside A is produced. In some additional embodiments, the present invention provides methods for producing rebaudioside I, comprising providing a stevioside substrate, ADP-glucose, and at least one engineered glycosyltransferase provided herein, combining the stevioside substrate, ADP-glucose, and glycosyltransferase under conditions such that rebaudioside I is produced. In some of the present embodiments, the engineered glycosyltransferase comprises an ADP-glycosyltransferase.

The present invention also provides methods for producing rebaudioside D, comprising providing a stevioside substrate, ADP-glucose, and at least one engineered glycosyltransferase provided herein, combining the stevioside substrate, ADP-glucose, and glycosyltransferase under conditions such that rebaudioside D is produced. In some of the present embodiments, the engineered glycosyltransferase comprises an ADP-glycosyltransferase.

The present invention also provides methods for producing rebaudioside M comprising providing a rebaudioside D substrate, NDP, sucrose, a sucrose synthase, and at least one engineered glycosyltransferase provided herein, combining the rebaudioside D substrate, NDP, sucrose, sucrose synthase, and glycosyltransferase under conditions such that rebaudioside M is produced. In some of the present embodiments, the engineered glycosyltransferase comprises an ADP-glycosyltransferase.

In some additional embodiments, the NDP is selected from ADP, CDP, TDP, GDP, and/or IDT. In some additional embodiments, the NDP is not UDP.

The present invention also provides methods for producing rebaudioside A and/or rebaudioside I comprising providing a stevioside substrate, NDP, sucrose, a sucrose synthase, and at least one engineered glycosyltransferase provided herein, combining the stevioside substrate, NDP, sucrose, sucrose synthase, and glycosyltransferase under conditions such that rebaudioside A and/or rebaudioside I is produced. In some embodiments, the present invention provides methods for producing rebaudioside A, comprising providing a stevioside substrate, NDP, sucrose, a sucrose synthase, and at least one engineered glycosyltransferase provided herein, combining the stevioside substrate, NDP, sucrose, sucrose synthase, and glycosyltransferase under conditions such that rebaudioside A is produced. In some additional embodiments, the present invention provides methods for producing rebaudioside I, comprising providing a stevioside substrate, NDP, sucrose, a sucrose synthase, and at least one engineered ADP-glycosyltransferase provided herein, combining the stevioside substrate, NDP, sucrose, sucrose synthase and an ADP-glycosyltransferase under conditions such that rebaudioside I is produced. In some of the present embodiments, the engineered glycosyltransferase comprises an ADP-glycosyltransferase. In some additional embodiments, the NDP is selected from ADP, CDP, TDP, GDP, and/or IDT. In some additional embodiments, the NDP is not UDP.

The present invention also provides methods for producing rebaudioside D, comprising providing a stevioside substrate, NDP, sucrose, a sucrose synthase, and at least one engineered glycosyltransferase provided herein, combining the stevioside substrate, NDP, sucrose, sucrose synthase, and glycosyltransferase under conditions such that rebaudioside D is produced. In some of the present embodiments, the engineered glycosyltransferase comprises an ADP-glycosyltransferase.

In some additional embodiments, the NDP is selected from ADP, CDP, TDP, GDP, and/or IDT. In some additional embodiments, the NDP is not UDP.

The present invention also provides methods for producing rebaudioside M, comprising providing a stevioside substrate comprising at least one stevioside and/or a mixture of steviosides and rebA, NDP, sucrose, a sucrose synthase, and at least one engineered glycosyltransferase provided herein, combining the stevioside substrate, NDP, sucrose, sucrose synthase, and glycosyltransferase under conditions such that rebaudioside M is produced. In some of the present embodiments, the engineered glycosyltransferase comprises an ADP-glycosyltransferase. In some additional embodiments, the NDP is selected from ADP, CDP, TDP, GDP, and/or IDT. In some additional embodiments, the NDP is not UDP.

The present invention also provides methods for producing rebaudioside M, comprising providing a stevioside substrate, NDP, sucrose, at least one sucrose synthase, and at least one engineered glycosyltransferase o provided herein, combining the stevioside substrate, NDP, and glycosyltransferase under conditions such that rebaudioside A is first produced, rebaudioside D and/or rebaudioside I is then produced, and rebaudioside M finally produced. In some of the present embodiments, the engineered glycosyltransferase comprises an ADP-glycosyltransferase. In some additional embodiments, the NDP is selected from ADP, CDP, TDP, GDP, and/or IDT. In some additional embodiments, the NDP is not UDP.

In some embodiments of the methods of the present invention for the production of rebaudioside(s), the methods are conducted as one-pot reactions. In some additional embodiments, the methods are conducted sequentially. In some additional embodiments, the methods further comprise repeating the steps of the methods. In some further embodiments, sucrose is recycled during repeated steps. In some additional embodiments, at least one engineered glycosyltransferase and/or other reaction components are recycled. In some additional embodiments, the stevioside substrate is extracted from *Stevia rebaudiana*, while in some alternative embodiments, the stevioside substrate is synthetically produced, and still some further embodiments, the stevioside substrate is a mixture of steviosides that are either naturally and/or synthetically produced. In some further embodiments of the methods, at least one engineered glycosyltransferase is immobilized. In some additional embodiments of the methods, sucrose synthase is immobilized. In still some additional embodiments, at least one glycosyltransferase and/or the sucrose synthase is immobilized. In some further embodiments of the methods, a reaction product that includes fructose is produced. In some embodiments, the fructose is removed from the reaction product. In yet some additional embodiments, the methods further comprises a washing step. In some embodiments, the washing step comprises exposing the rebaudioside M, rebaudioside A, rebaudioside I, and/or rebaudioside D produced from the method to a solvent. In some embodiments, the solvent is water. In still further embodiments, the methods further comprise at least one column chromatography step. In some embodiments, at least one column chromatography step is conducted on the rebaudioside M, rebaudioside A, rebaudioside I, and/or rebaudioside D produced from the method. In some additional embodiments of the methods, the at least one engineered glycosyltransferase is a beta-1,2 glycosyltransferase provided herein. In some further embodiments of the methods, at least one engineered glycosyltransferase is a beta-1,3 glycosyltransferase provided herein. In yet some additional embodiments of the methods, at least one engineered glycosyltransferase is a beta-1,2 glycosyltransferase provided herein and at least one additional engineered glycosyltransferase is a beta-1,3 glycosyltransferase provided herein. In some further embodiments of the methods, at least one engineered sucrose synthase provided herein finds use.

In the methods provided herein, at least one engineered glycosyltransferase comprising a polypeptide sequence that has at least 90%, 91%, 92%, 93%, 94%, 95%, 96%, 97%, 98%, 99%, or more sequence identity to SEQ ID NO: 6, 8, 10, 12, 14, 16, 18, 20, 22, 24, 26, 28, 30, 22, 34, 36, 38, 40, 42, 44, 46, 48, 50, 52, 54, 56, 58, 60, 62, 64, 66, 68, 70, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1290, 1292, 1294, 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656, 2658, 2660, 2662, 2664, 2666, 2668, 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, 2774, 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2830, 2932, 2934, 2936, 2938, 2940, 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, 3490, 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, 3652, 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, 3850, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, 3898, 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120, 4122, 4124, 4126, 4128, 4130, 4132, 4134, 4136, 4138, 4140, 4142, 4144, 4146, 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212, 4214, 4216, 4218, 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460, 4462, 4464, 4466, 4468, 4470, 4472, 4474, 4476, 4478, 4480, 4482, 4484, 4486, 4488, 4490, 4492, 4494, 4496, 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4640, 4642, 4644, 4646, 4648, 4650, 4652, 4654, 4656, 4658, 4660, 4662, 4664, 4666, 4668, 4670, 4672, 4674, 4676, 4678, 4680, 4682, 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4902, 4804, 4806, 4808, 4810, 4812, 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, 4874, 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, 5016, 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, 5260, 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, 5342, 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, 5542, 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, 5642, 5644, 5646, 5648, 5650, 5652, 5654, 5656, 5658, 5660, 5662, 5664, 5666, 5668, 5670, 5672, 5674, 5676, 5678, 5680, 5682, 5684, 5686, 5688, 5690, 5692, 5694, 5696, 5698, 5700, 5702, 5704, 5706, 5708, 5710, 5712, 5714, 5716, 5718, 5720, 5722, 5724, 5726, 5728, 5730, 5732, 5734, 5736, 5738, 5740, 5742, 5744, 5746, 5748, 5750, 5752, 5754, 5756, 5758, 5760, 5762, 5764, 5766, 5768, 5770, 5772, 5774, 5776, 5778, 5780, 5782, 5784, 5786, 5788, 5790, 5792, 5794, 5796, 5798, 5800, 5802, 5804, 5806, 5808, 5810, 5812, 5814, 5816, 5818, 5820, 5822, 5824, 5826, 5828, 5830, 5832, 5834, 5836, 5838, 5840, 5842, 5844, 5846, 5848, 5850, 5852, 5854, 5856, 5858, 5860, 5862, 5864, 5866, 5868, 5870, 5872, 5874, 5876, 5878, 5880, 5882, 5884, 5886, 5888, 5890, 5892, 5894, 5896, 5898, 5900, 5902, 5904, 5906, 5908, 5910, 5912, 5914, 5916, 5918, 5920, 5922, 5924, 5926, 5928, 5930, 5932, 5934, 5936, 5938, 5940, 5942, 5944, 5946, 5948, 5950, 5952, 5954, 5956, 5958, 5960, 5962, 5964, 5966, 5968, 5970, 5972, 5974, 5976, 5978, 5980, 5982, 5984, 5986, 5988, 5990, 5992, 5994, 5996, 5998, 6000, 6002, 6004, 6006, 6008, 6010, 6012, 6014, 6016, 6018, 6020, 6022, 6024, 6026, 6028, 6030, 6032, 6034, 6036, 6038, 6040, 6042, 6044, 6046, 6048, 6050, 6052, 6054, 6056, 6058, 6060, 6062, 6064, 6066, 6068, 6070, 6072, 6074, 6076, 6078, 6080, 6082, 6084, 6086, 6088, 6090, 6092, 6094, 6096, 6098, 6100, 6102, 6104, 6106, 6108, 6110, 6112, 6114, 6116, 6118, 6120, 6122, 6124, 6126, 6128, 6130, 6132, 6134, 6136, 6138, 6140, 6142, 6144, 6146, 6148, 6150, 6152, 6154, 6156, 6158, 6160, 6162, 6164, 6166, 6168, 6170, 6172, 6174, 6176, 6178, 6180, 6182, 6184, 6186, 6188, 6190, 6192, 6194, 6196, 6198, 6200, 6202, 6204, 6206, 6208, 6210, 6212, 6214, 6216, 6218, 6220, 6222, 6224, 6226, 6228, 6230, 6232, 6234, 6236, 6238, 6240, 6242, 6244, 6246, 6248, 6250, 6252, 6254, 6256, 6258, 6260, 6262, 6264, 6266, 6268, 6270, 6272, 6274, 6276, 6278, 6280, 6282, 6284, 6286, 6288, 6290, 6292, 6294, 6296, 6298, 6300, 6302, 6304, 6306, 6308, 6310, 6312, 6314, 6316, 6318, 6320, 6322, 6324, 6326, 6328, 6330, 6332, 6334, 6336, 6338, 6340, 6342, 6344, 6346, 6348, 6350, 6352, 6354, 6356, 6358, 6360, 6362, 6364, 6366, 6368, 6370, 6372, 6374, 6376, 6378, 6380, 6382, 6384, 6386, 6388, 6390, 6392, 6394, 6396, 6398, 6400, 6402, 6404, 6406, 6408, 6410, 6412, 6414, 6416, 6418, 6420, 6422, 6424, 6426, 6428, 6430, 6432, 6434, 6436, 6438, 6440, 6442, 6444, 6446, 6448, 6450, 6452, 6454, 6456, 6458, 6460, 6462, 6464, 6466, 6468, 6470, 6472, 6474, 6476, 6478, 6480, 6482, 6484, 6486, 6488, 6490, 6492, 6494, 6496, 6498, 6500, 6502, 6504, 6506, 6508, 6510, 6512, 6514, 6516, 6518, 6520, 6522, 6524, 6526, 6528, 6530, 6532, 6534, 6536, 6538, 6540, 6542, 6544, 6546, 6548, 6550, 6552, 6554, 6556, 6558, 6560, 6562, 6564, 6566, 6568, 6570, 6572, 6574, 6576, 6578, 6580, 6582, 6584, 6586, 6588, 6590, 6592, 6594, 6596, 6598, 6600, 6602, 6604, 6606, 6608, 6610, 6612, 6614, 6616, 6618, 6620, 6622, 6624, 6626, 6628, 6630, 6632, 6634, 6636, 6638, 6640, 6642, 6644, 6646, 6648, 6650, 6652, 6654, 6656, 6658, 6660, 6662, 6664, 6666, 6668, 6670, 6672, 6674, 6676, 6678, 6680, 6682, 6684, 6686, 6688, 6690, 6692, 6694, 6696, 6698, 6700, 6702, 6704, 6706, 6708, 6710, 6712, 6714, 6716, 6718, 6720, 6722, 6724, 6726, 6728, 6730, 6732, 6734, 6736, 6738, 6740, 6742, 6744, 6746, 6748, 6750, 6752, 6754, 6756, 6758, 6760, 6762, 6764, 6766, 6768, 6770, 6772, 6774, 6776, 6778, 6780, 6782, 6784, 6786, 6788, 6790, 6792, 6794, 6796, 6798, 6800, 6802, 6804, 6806, 6808, 6810, 6812, 6814, 6816, 6818, 6820, 6822, 6824, 6826, 6828, 6830, 6832, 6834, 6836, 6838, 6840, 6842, 6844, 6846, 6848, 6850, 6852, 6854, 6856, 6858, 6860, 6862, 6864, 6866, 6868, 6870, 6872, 6874, 6876, 6878, 6880, 6882, 6884, 6886, 6888, 6890, 6892, 6894, 6896, 6898, 6900, 6902, 6904, 6906, 6908, 6910, 6912, 6914, 6916, 6918, 6920, 6922, 6924, 6926, 6928, 6930, 6932, 6934, 6936, 6938, 6940, 6942, 6944, 6946, 6948, 6950, 6952, 6954, 6956, 6958, 6960, 6962, 6964, 6966, 6968, 6970, 6972, 6974, 6976, 6978, 6980, 6982, 6984, 6986, 6988, 6990, 6992, 6994, 6996, 6998, 7000, 7002, 7004, 7006, 7008, 7010, 7012, 7014, 7016, 7018, 7020, 7022, 7024, 7026, 7028, 7030, 7032, 7034, 7036, 7038, 7040, 7042, 7044, 7046, 7048, 7050, 7052, 7054, 7056, 7058, 7060, 7062, 7064, 7066, 7068, 7070, 7072, 7074, 7076, 7078, 7080, 7082, 7084, 7086, 7088, 7090, 7092, 7094, 7096, 7098, 7100, 7102, 7104, 7106, 7108, 7110, 7112, 7114, 7116, 7118, 7120, 7122, 7124, 7126, 7128, 7130, 7132, 7134, 7136, 7138, 7140, 7142, 7144, 7146, 7148, 7150, 7152, 7154, 7156, 7158, 7160, 7162, 7164, 7166, 7168, 7170, 7172, 7174, 7176, 7178, 7180, 7182, 7184, 7186, 7188, 7190, 7192, 7194, 7196, 7198, 7200, 7202, 7204, 7206, 7208, 7210, 7212, 7214, 7216, 7218, 7220, 7222, 7224, 7226, 7228, 7230, 7232, 7234, 7236, 7238, 7240, 7242, 7244, 7246, 7248, 7250, 7252, 7254, 7256, 7258, 7260, 7262, 7264, 7266, 7268, 7270, 7272, 7274, 7276, 7278, 7280, 7282, 7284, 7286, 7288, 7290, 7292, 7294, 7296, 7298, 7300, 7302, 7304, 7306, 7308, 7310, 7312, 7314, 7316, 7318, 7320, 7322, 7324, 7326, 7328, 7330, 7332, 7334, 7336, 7338, 7340, 7342, 7344, 7346, 7348, 7350, 7352, 7354, 7356, 7358, 7360, 7362, 7364, 7366, 7368, 7370, 7372, 7374, 7376, 7378, 7380, 7382, 7384, 7386, 7388, 7390, 7392, 7394, 7396, 7398, 7400, 7402, 7404, 7406, 7408, 7410, 7412, 7414, 7416, 7418, 7420, 7422, 7424, 7426, 7428, 7430, 7432, 7434, 7436, 7766, 7768, 7770, 7772, 7774, 7776, 7778, 7780, 7782, 7784, 7786, 7788, 7790, 7792, 7794, 7796, 7798, 7800, 7812, 7814, 7816, 7818, 7820, 7822, 7824, 7826, 7828, 7830, 7832, 7834, 7836, 7838, 7840, 7842, 7844, 7846, 7848, 7850, 7852, 7854, 7856, 7858, 7860, 7862, 7864, 7866, 7868, 7870, 7872, 7874, 7876, 7878, 7880, 7882, 7884, 7886, 7888, 7890, 7892, 7894, 7896, 7898, 7900, 7902, 7904, 7906, 7908, 7910, 7912, 7914, 7916, 7918, 7920, 7922, 7924, 7926, 7928, 7930, 7932, 7934, 7936, 7938, 7940, 7942, 7944, 7946, 7948, 7950, 7952, 7954, 7956, 7958, 7960, 7962, 7964, 7966, 7968, 7970, 7972, 7974, 7976, 7978, 7980, 7982, 7984, 7986, 7988, 7990, 7992, 7994, 7996, 7998, 8000, 8002, 8004, 8006, 8008, 8010, 8012, 8014, 8016, 8018, 8020, 8022, 8024, 8026, 8028, 8030, 8032, 8034, 8036, 8038, 8040, 8042, 8044, 8046, 8048, 8050, 8052, 8054, 8056, 8058, 8060, 8062, 8064, 8066, 8068, 8070, 8072, 8074, 8076, 8078, 8080, 8082, 8084, 8086, 8088, 8090, 8092, 8094, 8096, 8098, 8100, 8102, 8104, 8106, 8108, 8110, 8112, 8114, 8116, 8118, 8120, 8122, 8124, 8126, 8128, 8130, 8132, 8134, 8136, 8138, 8140, 8142, 8144, 8146, 8148, 8150, 8152, 8154, 8156, 8158, 8160, 8162, 8164, 8166, 8168, 8170, 8172, 8174, 8176, 8178, 8180, 8182, 8184, 8186, 8188, 8190, 8192, 8194, 8196, 8198, 8200, 8202, 8204, 8206, 8208, 8210, 8212, 8214, 8216, 8218, 8220, 8222, 8224, 8226, 8228, 8230, 8232, 8234, 8236, 8238, 8240, 8242, 8244, 8246, 8248, 8250, 8252, 8254, 8256, 8258, 8260, 8262, 8264, 8266, 8268, 8270, 8272, 8274, 8276, 8278, 8280, 8282, 8284, 8286, 8288, 8290, 8292, 8294, 8296, 8298, 8300, 8302, 8304, 8306, 8308, 8310, 8312, 8314, 8316, 8318, 8320, 8322, 8324, 8326, 8328, 8330, 8332, 8334, 8336, 8338, 8340, 8342, 8344, 8346, 8348, 8350, 8352, 8354, 8356, 8358, 8360, 8362, 8364, 8366, 8368, 8482, 8484, 8486, 8488, 8490, 8492, 8494, 8496, 8498, 8500, 8502, 8504, 8506, 8508, 8510, 8512, 8514, 8516, 8518, 8520, 8522, 8524, 8526, 8528, 8530, 8532, 8534, 8536, 8538, 8540, 8542, 8544, 8546, 8548, 8550, 8552, 8554, 8556, 8558, 8560, 8562, 8564, 8566, 8568, 8570, 8572, 8574, 8576, 8578, 8580, 8582, 8584, 8586, 8588, 8590, 8592, 8594, 8596, 8598, 8600, 8602, 8604, 8606, 8608, 8610, 8612, 8614, 8616, 8618, 8620, 8622, 8624, 8626, 8628, 8630, 8632, 8634, 8636, 8638, 8640, 8642, 8644, 8646, 8648, 8650, 8652, 8654, 8656, 8658, 8660, 8662, 8664, 8666, 8668, 8670, 8672, 8674, 8676, 8678, 8680, 8682, 8684, 8686, 8688, 8690, 8692, 8694, 8696, 8698, 8700, 8702, 8704, 8706, 8708, 8710, 8712, 8714, 8716, 8718, 8720, 8722, 8724, 8726, 8728, 8730, 8732, 8734, 8736, 8738, 8740, 8742, 8744, 8746, 8748, 8750, 8752, 8754, 8756, 8758, 8760, 8762, 8764, 8766, 8768, 8770, 8772, 8774, 8776, 8778, 8780, 8782, 8784, 8786, 8788, 8790, 8792, 8794, 8796, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, 9222, 9224, 9226, 9228, 9230, 9232, 9234, 9236, 9238, and/or 9240 finds use.

In the methods provided herein, at least one engineered glycosyltransferase comprising polypeptide sequence that has at least 90%, 91%, 92%, 93%, 94%, 95%, 96%, 97%, 98%, 99%, or more sequence identity to SEQ ID NO: 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, 2594, 7438, 7440, 7442, 7444, 7446, 7448, 7450, 7452, 7454, 7456, 7458, 7460, 7462, 7464, 7466, 7468, 7470, 7472, 7474, 7476, 7478, 7480, 7482, 7484, 7486, 7488, 7490, 7492, 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558, 7560, 7562, 7564, 7566, 7568, 7570, 7572, 7574, 7576, 7578, 7580, 7582, 7584, 7586, 7588, 7590, 7592, 7594, 7596, 7598, 7600, 7602, 7604, 7606, 7608, 7610, 7612, 7614, 7616, 7618, 7620, 7622, 7624, 7626, 7628, 7630, 7632, 7634, 7636, 7638, 7640, 7642, 7644, 7646, 7648, 7650, 7652, 7654, 7656, 7658, 7660, 7662, 7664, 7666, 7668, 7670, 7672, 7674, 7676, 7678, 7680, 7682, 7684, 7686, 7688, 7690, 7692, 7694, 7696, 7698, 7700, 7702, 7704, 7706, 7708, 7710, 7712, 7714, 7716, 7718, 7720, 7722, 7724, 7726, 7728, 7730, 7732, 7734, 7736, 7738, 7740, 7742, 7744, 7746, 7748, 7750, 7752, 7754, 7756, 7758, 7760, 7762, 7764, 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442, 8444, 8446, 8448, 8450, 8452, 8454, 8456, 8458, 8460, 8462, 8464, 8466, 8468, 8470, 8472, 8474, 8476, 8478, 8480, 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, and/or 9106 finds use.

The present invention also provides rebaudiosides and compositions comprising the rebaudiosides produced according to the methods provided herein. In some embodiments, the rebaudioside is rebaudioside M, while in some alternative embodiments, the rebaudioside is rebaudioside A, and in still further embodiments, the rebaudioside is rebaudioside I, and in some additional embodiments, the rebaudioside is rebaudioside D. In some further embodiments, the present invention provides a mixture of rebaudiosides produced according to the methods provided herein, including mixtures of rebaudioside M, rebaudioside A, rebaudioside I, and/or rebaudioside D, in any combination of concentrations of rebaudiosides and other components of interest. In some embodiments, the presentation invention provides compositions comprising mixtures of rebaudioside M, rebaudioside A, rebaudioside I, and/or rebaudioside D, in any combination of concentrations of rebaudiosides and other components of interest. Indeed, it is not intended that the present invention be limited to any particular combination or mixture of rebaudioside(s) produced according to the methods of the present invention.

The present invention provides methods for producing rebaudioside M, comprising providing a rebaudioside D and/or rebaudioside I substrate, NDP-glucose, and a least one engineered NDP-glycosyltransferase provided herein, combining the rebaudioside D and rebaudioside I substrate, NDP-glucose and an NDP-glycosyltransferase under conditions such that rebaudioside M is produced.

The present invention also provides methods for producing rebaudioside M, comprising providing a rebaudioside D substrate, NDP-glucose, and a least one engineered NDP-glycosyltransferase provided herein, combining the rebaudioside D substrate, NDP-glucose and an NDP-glycosyltransferase under conditions such that rebaudioside M is produced.

The present invention also provides methods for producing rebaudioside M, comprising providing a rebaudioside I substrate, NDP-glucose, and a least one engineered NDP-glycosyltransferase provided herein, combining the rebaudioside I substrate, NDP-glucose and an NDP-glycosyltransferase under conditions such that rebaudioside M is produced.

The present invention also provides methods for producing rebaudioside A and/or rebaudioside I, comprising providing a stevioside substrate, NDP-glucose, and at least one engineered NDP-glycosyltransferase provided herein, combining the stevioside substrate, NDP-glucose and an NDP-glycosyltransferase under conditions such that rebaudioside A and/or rebaudioside I is produced.

The present invention also provides methods for producing rebaudioside A, comprising providing a stevioside substrate, NDP-glucose, and at least one engineered NDP-glycosyltransferase provided herein, combining the stevioside substrate, NDP-glucose and an NDP-glycosyltransferase under conditions such that rebaudioside A is produced.

The present invention also provides methods for producing rebaudioside I, comprising providing a stevioside substrate, NDP-glucose, and at least one engineered NDP-glycosyltransferase provided herein, combining the stevioside substrate, NDP-glucose and an NDP-glycosyltransferase under conditions such that rebaudioside I is produced.

The present invention also provides methods for producing rebaudioside D, comprising providing a stevioside substrate, NDP-glucose, and at least one engineered NDP-glycosyltransferase provided herein, combining the stevioside substrate, NDP-glucose and an NDP-glycosyltransferase under conditions such that rebaudioside D is produced.

The present invention also provides methods for producing rebaudioside M comprising providing a rebaudioside D and/or rebaudioside I substrate, ADP-glucose, and at least one engineered ADP-glycosyltransferase provided herein, combining the rebaudioside D and/or rebaudioside I substrate, ADP-glucose and an ADP-glycosyltransferase under conditions such that rebaudioside M is produced.

The present invention also provides methods for producing rebaudioside M comprising providing a rebaudioside D substrate, ADP-glucose, and at least one engineered ADP-glycosyltransferase provided herein, combining the rebaudioside D substrate, ADP-glucose and an ADP-glycosyltransferase under conditions such that rebaudioside M is produced.

The present invention also provides methods for producing rebaudioside M comprising providing a rebaudioside I substrate, ADP-glucose, and at least one engineered ADP-glycosyltransferase provided herein, combining the rebaudioside I substrate, ADP-glucose and an ADP-glycosyltransferase under conditions such that rebaudioside M is produced.

The present invention also provides methods for producing rebaudioside A and/or rebaudioside I, comprising providing a stevioside substrate, ADP-glucose, and at least one engineered ADP-glycosyltransferase provided herein, combining the stevioside substrate, ADP-glucose and an ADP-glycosyltransferase under conditions such that rebaudioside A and/or rebaudioside I is produced.

The present invention also provides methods for producing rebaudioside A, comprising providing a stevioside substrate, ADP-glucose, and at least one engineered ADP-glycosyltransferase provided herein, combining the stevioside substrate, ADP-glucose and an ADP-glycosyltransferase under conditions such that rebaudioside A is produced.

The present invention also provides methods for producing rebaudioside I, comprising providing a stevioside substrate, ADP-glucose, and at least one engineered ADP-glycosyltransferase provided herein, combining the stevioside substrate, ADP-glucose and an ADP-glycosyltransferase under conditions such that rebaudioside I is produced.

The present invention also provides methods for producing rebaudioside D, comprising providing a stevioside substrate, ADP-glucose, and at least one engineered ADP-glycosyltransferase provided herein, and/or 118, combining the stevioside substrate, ADP-glucose and an ADP-glycosyltransferase under conditions such that rebaudioside D is produced.

The present invention also provides methods for producing rebaudioside M comprising providing a rebaudioside D substrate, NDP, sucrose, a sucrose synthase, and at least one engineered ADP-glycosyltransferase provided herein, combining the rebaudioside D substrate, NDP, sucrose, sucrose synthase and an ADP-glycosyltransferase under conditions such that rebaudioside M is produced. In some embodiments, the sucrose synthase is an engineered sucrose synthase provided herein. In some embodiments, a sugar other than sucrose finds use, in combination with the appropriate synthase.

The present invention also provides methods for producing rebaudioside A and/or rebaudioside I comprising providing a stevioside substrate, NDP, sucrose, a sucrose synthase, and at least one engineered ADP-glycosyltransferase provided herein, combining the stevioside substrate, NDP, sucrose, sucrose synthase and an ADP-glycosyltransferase under conditions such that rebaudioside A and/or rebaudioside I is produced. In some embodiments, the sucrose synthase is an engineered sucrose synthase provided herein. In some embodiments, a sugar other than sucrose finds use, in combination with the appropriate synthase.

The present invention also provides methods for producing rebaudioside A, comprising providing a stevioside substrate, NDP, sucrose, a sucrose synthase, and at least one engineered ADP-glycosyltransferase provided herein, combining the stevioside substrate, NDP, sucrose, sucrose synthase and an ADP-glycosyltransferase under conditions such that rebaudioside A is produced. In some embodiments, the sucrose synthase is an engineered sucrose synthase provided herein. In some embodiments, a sugar other than sucrose finds use, in combination with the appropriate synthase.

The present invention also provides methods for producing rebaudioside I, comprising providing a stevioside substrate, NDP, sucrose, a sucrose synthase, and at least one engineered ADP-glycosyltransferase provided herein, combining the stevioside substrate, NDP, sucrose, sucrose synthase and an ADP-glycosyltransferase under conditions such that rebaudioside A and/or rebaudioside I is produced. In some embodiments, the sucrose synthase is an engineered sucrose synthase provided herein. In some embodiments, a sugar other than sucrose finds use, in combination with the appropriate synthase.

The present invention also provides methods for producing rebaudioside D, comprising providing a stevioside substrate, NDP, sucrose, a sucrose synthase, and at least one engineered ADP-glycosyltransferase provided herein, combining the stevioside substrate, NDP, sucrose, sucrose synthase and an ADP-glycosyltransferase under conditions such that rebaudioside D is produced. In some embodiments, sucrose synthase is an engineered sucrose synthase provided herein. In some embodiments, a sugar other than sucrose finds use, in combination with the appropriate synthase.

The present invention also provides methods for producing rebaudioside M, comprising providing a stevioside substrate comprising at least one stevioside and/or a mixture of steviosides and rebA, NDP, sucrose, a sucrose synthase, and at least one engineered ADP-glycosyltransferase provided herein, combining the stevioside substrate, NDP, sucrose, sucrose synthase and an ADP-glycosyltransferase under conditions such that rebaudioside D is produced. In some embodiments, the sucrose synthase is an engineered sucrose synthase provided herein. In some embodiments, a sugar other than sucrose finds use, in combination with the appropriate synthase.

The present invention also provides methods of producing rebaudioside M, comprising providing a stevioside substrate, NDP, sucrose, at least one sucrose synthase, and at least one engineered ADP-glycosyltransferase provided herein, combining the stevioside substrate, NDP, and an ADP-glycosyltransferase under conditions such that rebaudioside A is first produced, rebaudioside D and/or rebaudioside I is then produced, and rebaudioside M finally produced. In some embodiments, the methods further comprise sucrose and sucrose synthase. In some embodiments, the sucrose synthase is an engineered sucrose synthase provided herein.

In some embodiments, the methods provided by the present invention are conducted as one-pot reaction, while in some alternative embodiments, the methods are conducted in multiple reaction vessels. In some embodiments, the methods are conducted in single and/or multiple reaction vessels in a sequential manner. In some embodiments, the method steps are repeated (i.e., there are multiple iterations of some or all of the steps of the methods). In some embodiments, the sucrose is recycled during repeated steps. In some additional embodiments, engineered glycosyltransferase and/or other reaction components (e.g., co-factors) are recycled. In some embodiments of the methods, the stevioside substrate is extracted from *Stevia rebaudiana*, while in some alternative methods, the stevioside substrate is synthetically produced. In some further embodiments, the glycosyltransferase is immobilized. In some additional embodiments, the sucrose synthase is immobilized. In some further embodiments, the glycosyltransferase and/or the sucrose synthase is immobilized. In some embodiments of the methods, fructose is produced. In some additional embodiments, fructose is removed from the reaction products.

The present invention also provides compositions comprising at least one engineered glycosyltransferase variant provided herein. The present invention also provides compositions comprising at least one non-naturally occurring glycosyltransferase variant as provided herein.

The present invention also provides methods for glycosylation of a substrate to produce a beta-glycosylated product, comprising the steps of: providing at least one glycosyl group donor, a least one glycosyl group acceptor, and at least one glycosyltransferase enzyme; contacting the glycosyl group donor and glycosyl group acceptor with the glycosyltransferase enzyme under conditions such that the glycosyl group acceptor is glycosylated to produce at least one product having beta-glucose linkages. In some embodiments of the methods, the glycosyl group donor is a nucleotide diphosphate sugar, for example adenine diphosphoglucose (ADP-glucose). In some further embodiments of the methods, the glycosyl group acceptor is selected from glycosyl, alkoxy, carboxy, aminocarbonyl, heteroalkyl, heteroalkenyl, heteroalkynyl, carboxyalkyl, aminoalkyl, haloalkyl, alkylthioalkyl, heterocycloalkyl, heteroaryl, and heteroarylalkyl groups. In some yet additional embodiments of the methods, the product having beta-glucose linkages is a steviol glycoside. In some further embodiments of the methods, the glycosyl group acceptor is rebaudioside D, the glycosyl group donor is ADP-glucose, and the product having beta-glucose linkages is rebaudioside M. In some further embodiments of the methods, the glycosyl group acceptor is stevioside, the glycosyl group donor is ADP-glucose, and the product having beta-glucose linkages is rebaudioside A or rebaudioside I.

The present invention also provides methods for production of nucleoside diphosphoglucose, comprising the steps of: providing a nucleoside diphosphate-dependent synthase, a nucleoside diphosphate, and a disaccharide, trisaccharide, or oligosaccharide substrate of the synthase; contacting the synthase, nucleoside diphosphate, and saccharide under conditions such that the saccharide is cleaved to produce a lower molecular weight saccharide and nucleoside diphosphoglucose. In some embodiments of the method, this method is combined with the previously described method. In some additional embodiments of the method, the nucleoside diphosphate is ADP, the nucleoside diphosphoglucose is ADP-glucose, and the synthase substrate is sucrose.

DESCRIPTION OF THE INVENTION

Figure 1:
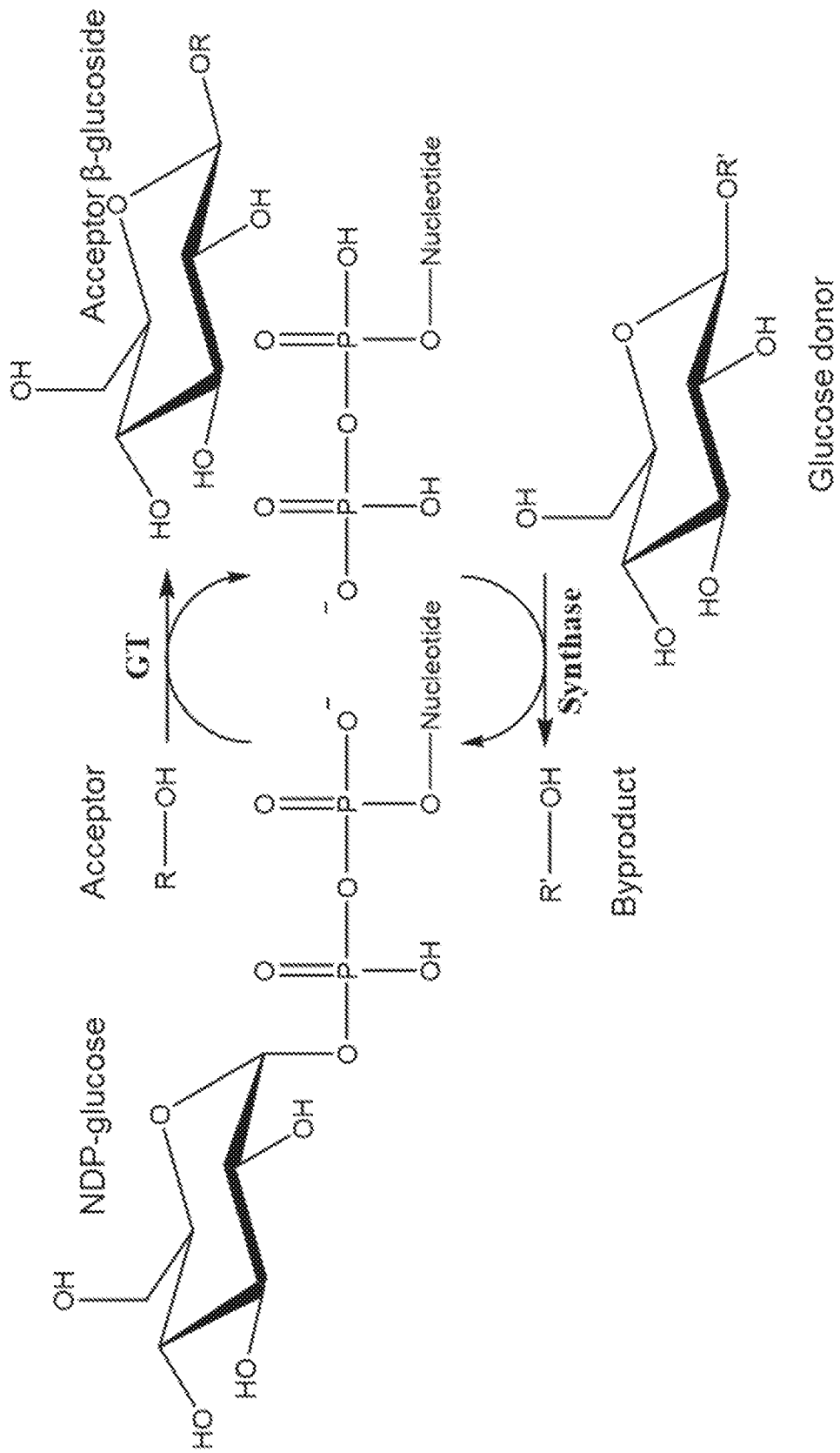
FIG. 1 provides an enzymatic reaction scheme in which a glycosyltransferase catalyzes the transfer of a glucosyl group from a nucleoside diphosphoglucose (NDP-glucose), for example ADP-glucose, to an acceptor, for example R—OH, where R is any glycosyl, alkoxy, carboxy, aminocarbonyl, heteroalkyl, heteroalkenyl, heteroalkynyl, carboxyalkyl, aminoalkyl, haloalkyl, alkylthioalkyl, heterocycloalkyl, heteroaryl, or heteroarylalkyl group. In a further embodiment, R—OH is a stevioside or rebaudioside D, and the product is rebaudioside A, rebaudioside I, or rebaudioside M. A nucleoside diphosphate dependent synthase catalyzes the transfer of a glucosyl group from a glucose donor (e.g., sucrose), to a nucleoside diphosphate, regenerating NDP-glucose and releasing a byproduct (e.g., fructose).

The present invention provides engineered glycosyltransferase (GT) enzymes, polypeptides having GT activity, and polynucleotides encoding these enzymes, as well as vectors and host cells comprising these polynucleotides and polypeptides. The present invention provides engineered sucrose synthase (SuS) enzymes, polypeptides having SuS activity, and polynucleotides encoding these enzymes, as well as vectors and host cells comprising these polynucleotides and polypeptides.

The present invention also provides compositions comprising the GT enzymes and methods of using the engineered GT enzymes to make products with β-glucose linkages. The present invention further provides compositions and methods for the production of rebaudiosides (e.g., rebaudioside M, rebaudioside A, rebaudioside I, and rebaudioside D). The present invention also provides compositions comprising the SuS enzymes and methods of using them. Methods for producing GT and SuS enzymes are also provided.

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

Abbreviations

The abbreviations used for the genetically encoded amino acids are conventional and are as follows:

| Amino Acid | Three-Letter Abbreviation | One-Letter Abbreviation |
| --- | --- | --- |
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

Definitions

In reference to the present invention, the technical and scientific terms used in the descriptions herein will have the meanings commonly understood by one of ordinary skill in the art, unless specifically defined otherwise. Accordingly, the following terms are intended to have the following meanings.

As used herein, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," and "including" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

As used herein, the term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation or phosphorylation). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "polynucleotide" and "nucleic acid" refer to two or more nucleotides that are covalently linked together. The polynucleotide may be wholly comprised of ribonucleotides (i.e., RNA), wholly comprised of 2' deoxyribonucleotides (i.e., DNA), or comprised of mixtures of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

As used herein, "nucleoside" refers to glycosylamines comprising a nucleobase (i.e., a nitrogenous base), and a 5-carbon sugar (e.g., ribose or deoxyribose). Non-limiting examples of nucleosides include cytidine, uridine, adenosine, guanosine, thymidine, and inosine. In contrast, the term "nucleotide" refers to the glycosylamines comprising a nucleobase, a 5-carbon sugar, and one or more phosphate groups. In some embodiments, nucleosides can be phosphorylated by kinases to produce nucleotides.

As used herein, "nucleoside diphosphate" refers to glycosylamines comprising a nucleobase (i.e., a nitrogenous base), a 5-carbon sugar (e.g., ribose or deoxyribose), and a diphosphate (i.e., pyrophosphate) moiety. In some embodiments herein, "nucleoside diphosphate" is abbreviated as "NDP." Non-limiting examples of nucleoside diphosphates include cytidine diphosphate (CDP), uridine diphosphate (UDP), adenosine diphosphate (ADP), guanosine diphosphate (GDP), thymidine diphosphate (TDP), and inosine diphosphate. The terms "nucleoside" and "nucleotide" may be used interchangeably in some contexts.

As used herein, "coding sequence" refers to that portion of a nucleic acid (e.g., a gene) that encodes an amino acid sequence of a protein.

As used herein, the terms "biocatalysis," "biocatalytic," "biotransformation," and "biosynthesis" refer to the use of enzymes to perform chemical reactions on organic compounds.

As used herein, "glycosyltransferase" (GT) refers to a polypeptide having an enzymatic capability of transferring glycosyl residues from an activated sugar donor to monomeric and polymeric acceptor molecules. In some embodiments, the glycosyltransferases are referred to as "glycosyltransferase variants" or "glycosyltransferase combinatorial variants." In some embodiments, "glycosyltransferase" refers to an UDP-glucuronosyltransferase enzyme of the classification EC 2.4.1.17, which catalyzes the transfer of glucose from UDP-α-D-glucuronate (also known as UDP-glucose) to an acceptor, releasing UDP and forming acceptor β-D-glucuronoside. The Carbohydrate-Active Enzymes database (CAZy) provides a continuously updated list of the glycosyltransferase families. In some embodiments, the glycosyltransferases include, but are not limited to, enzymes classified in the GT1 family. In some preferred embodiments, the glycosyltransferase variants of the present invention preferentially utilize ADP-glucose. In some additional embodiments, the glycosyltransferase enzymes of the present invention do not utilize UDP-glucose. In some further embodiments, the glycosyltransferase variants of the present invention utilize ADP-glucose, CDP-glucose, TDP-glucose, GDP-glucose, and/or IDT-glucose, but not UDP-glucose. Thus, in some preferred embodiments, the present invention provides ADP-glucose-dependent glycosyltransferases (ADP-glycosyltransferases; AGTs), CDP-glucose-dependent glycosyltransferases (CDP-glycosyltransferases; CGTs), GDP-glucose-dependent glycosyltransferases (GDP-glycosyltransferases; GGTs), TDP-glucose-dependent glycosyltransferases (TDP-glycosyltransferases; TGTs), and IDP-glucose-dependent glycosyltransferase (IDP-glycosyltransferases; IGTs).

As used herein, "NDP-glycosyltransferase" (NDP-GT) refers to a polypeptide having an enzymatic capability of transferring glycosyl residues from an activated sugar donor that is an NDP to monomeric and polymeric acceptor molecules. In some embodiments, NDP-glycosyltransferases are generally referred to as "glycosyltransferases." Indeed, the term "glycosyltransferase" as used herein encompasses NDP-glycosyltransferases, including, but not limited to ADP-glucose-dependent glycosyltransferases (ADP-glycosyltransferases; AGTs), CDP-glucose-dependent glycosyltransferases (CDP-glycosyltransferases; CGTs), GDP-glucose-dependent glycosyltransferase (GDP-glycosyltransferases; GGTs), TDP-glucose-dependent glycosyltransferases (TDP-glycosyltransferases; TGTs), and IDP-glucose-dependent glycosyltransferase (IDP-glycosyltransferases; IGTs). In some embodiments, the glycosyltransferase enzymes of the present invention utilize ADP-glucose, CDP-glucose, TDP-glucose, GDP-glucose, and/or IDT-glucose, but not UDP-glucose. In some additional embodiments the enzymes are referred to as "variants" or "combinatorial variants" (e.g., ADP-glycosyltransferase variants).

As used herein, "transglycosylation" refers to a reaction in which a glycosyl residue is transferred from a disaccharide, trisaccharide, or oligosaccharide donor to an aglycosylated or glycosylated acceptor molecule.

As used herein, "transglucosylation" refers to a transglycosylation reaction in which the glycosyl residue that is transferred is a glucose and the disaccharide, trisaccharide, or oligosaccharide donor contains glucose.

As used herein, "glycosylation" refers to the formation of a glycosidic linkage between a glycosyl residue and an acceptor molecule.

As used herein, "glucosylation" refers to the formation of a glycosidic linkage between a glucose residue and an acceptor molecule.

As used herein, "glycosyl" refers to an organic group that is a univalent free radical or substituent structure obtained by removing the hemiacetal hydroxyl group from the cyclic form of a monosaccharide, lower oligosaccharide or oligosaccharide derivative. Glycosyl groups react with inorganic acids (e.g., phosphoric acid) to form esters (e.g., glucose 1-phosphate).

As used herein, "glycoside" refers to a molecule in which a carbohydrate (e.g., sugar) is bound to another functional group by a glycosidic bond. Glycosides can be hydrolyzed to produce a sugar and a non-sugar (i.e., aglycone) component.

As used herein, the term "steviol glycoside" refers to a glycoside of steviol, including but not limited to, naturally occurring steviol glycosides (e.g., stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O), and synthetic steviol glycosides (e.g., enzymatically glucosylated steviol glycosides), and combinations thereof. The chemical structures of steviol and its glycosides are below (See, WO 2013/176738).

As used herein, "stevioside substrate" refers to any suitable material comprising at least one steviol glycoside.

Chemical Structure of Steviol and Its Glycosides

| Glycoside | $R_1$ | $R_2$ |
|---|---|---|
| Steviol | H | H |
| Steviolmonoside | H | Glcβ1- |
| Steviol monoglucosyl ester | Glcβ1- | H |
| Rubusoside | Glcβ1- | Glcβ1- |
| Steviolbioside | H | Glcβ (1-2) Glcβ1- |
| Dulcoside A | Glcβ1- | Rhaα(1-2) Glcβ1- |
| Stevioside | Glcβ1- | Glcβ (1-2) Glcβ1- |
| Rebaudioside B | H | Glcβ (1-2)[Glcβ (1-3)] Glcβ1- |
| Rebaudioside C | Glcβ1- | Rhaα(1-2)[Glcβ (1-3)] Glcβ1- |
| Rebaudioside A | Glcβ1- | Glcβ (1-2)[Glcβ (1-3)] Glcβ1- |
| Rebaudioside D | Glcβ (1-2) Glcβ1- | Glcβ (1-2)[Glcβ (1-3)] Glcβ1- |
| Rebaudioside I | Glcβ (1-3) Glcβ1- | Glcβ (1-2)[Glcβ (1-3)] Glcβ1- |
| Rebaudioside M | Glcβ (1-2)[Glcβ (1-3)]Glcβ1- | Glcβ (1-2)[Glcβ (1-3)] Glcβ1- |

(Glc = glucose, Rha = rhamnose)

As used herein, "sucrose synthase" refers to a glycosyltransferase enzyme (EC 2.4.1.1.13) that reversibly catalyzes the chemical reaction NDP-glucose+D-fructose to NDP and sucrose. In some embodiments, the present invention provides variants of *Acidithiobacillus caldus* sucrose synthase ("AcSuS"). In some embodiments, these enzymes are referred to as "sucrose synthase variants," "SuS," "SUS," "SUS variants," "SUS variants," "sucrose synthase combinatorial variants," or "SuS combinatorial variants," or "SUS combinatorial variants." In some embodiments, these variants preferentially utilize NDPs other than uridine (i.e., ADP-glucose, CDP-glucose, TDP-glucose, GDP-glucose, and/or IDP-glucose are utilized, rather than UDP-glucose). In some embodiments, these variants do not utilize UDP-glucose.

As used herein, the term "one-pot reaction" refers to the production of rebaudioside of interest in one reaction vessel. In some embodiments, the term is used in reference to the production of rebM from a starting material, including but not limited to asrebA and/or steviosides with the intermediate production of other rebaudiosides (e.g., rebD and/or rebI). In some embodiments, the conversion of stevioside to RebA, RebA to RebD and/or RebI and RebD and/or RebI to Reb M, are conducted as a multiple enzyme cascade in one reaction vessel.

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

As used herein, "recombinant," "engineered," and "non-naturally occurring" when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

As used herein, "reference sequence" refers to a defined sequence used as a basis for a sequence and/or activity comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptides are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

As used herein, "comparison window" refers to a conceptual segment of at least about 20 contiguous nucleotide positions or amino acid residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered glycosyltransferase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions that are not identical in sequences being compared differ by conservative amino acid substitutions.

As used herein, "amino acid difference" and "residue difference" refer to a difference in the amino acid residue at a position of a polypeptide sequence relative to the amino acid residue at a corresponding position in a reference sequence. In some cases, the reference sequence has a histidine tag, but the numbering is maintained relative to the equivalent reference sequence without the histidine tag. The positions of amino acid differences generally are referred to herein as "Xn," where n refers to the corresponding position in the reference sequence upon which the residue difference is based. For example, a "residue difference at position X93 as compared to SEQ ID NO:4" refers to a difference of the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in the Tables presented in the Examples), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with an hydroxyl side chain is substituted with another amino acid with an hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered glycosyltransferase enzyme. Deletions can be directed to the internal portions and/or terminal portions of the polypeptide. In various embodiments, the deletion can comprise a continuous segment or can be discontinuous. Deletions are typically indicated by "−" in amino acid sequences.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" and "biologically active fragment" are used interchangeably herein to refer to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered glycosyltransferase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., within a host cell or via in vitro synthesis). The recombinant glycosyltransferase polypeptides may be present within a cell, present in the cellular medium, or prepared in various forms, such as lysates or isolated preparations. As such, in some embodiments, the recombinant glycosyltransferase polypeptides can be an isolated polypeptide.

As used herein, "substantially pure polypeptide" or "purified protein" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising glycosyltransferase comprises glycosyltransferase that is less than 50% pure (e.g., about 10%, about 20%, about 30%, about 40%, or about 50%) Generally, a substantially pure glycosyltransferase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant glycosyltransferase polypeptides are substantially pure polypeptide compositions.

As used herein, "improved enzyme property" refers to at least one improved property of an enzyme. In some embodiments, the present invention provides engineered glycosyltransferase polypeptides that exhibit an improvement in any enzyme property as compared to a reference glycosyltransferase polypeptide and/or a wild-type glycosyltransferase polypeptide, and/or another engineered glycosyltransferase polypeptide. Thus, the level of "improvement" can be determined and compared between various glycosyltransferase polypeptides, including wild-type, as well as engineered glycosyltransferases. Improved properties include, but are not limited, to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, and altered temperature profile. In additional embodiments, the term is used in reference to the at least one improved property of sucrose synthase enzymes. In some embodiments, the present invention provides engineered sucrose synthase polypeptides that exhibit an improvement in any enzyme property as compared to a reference sucrose synthase polypeptide and/or a wild-type sucrose synthase polypeptide, and/or another engineered sucrose synthase polypeptide. Thus, the level of "improvement" can be determined and compared between various sucrose synthase polypeptides, including wild-type, as well as engineered sucrose synthases.

As used herein, "increased enzymatic activity" and "enhanced catalytic activity" refer to an improved property of the engineered polypeptides, which can be represented by an increase in specific activity (e.g., product produced/time/weight protein) or an increase in percent conversion of the substrate to the product (e.g., percent conversion of starting amount of substrate to product in a specified time period using a specified amount of enzyme) as compared to the reference enzyme. In some embodiments, the terms refer to an improved property of engineered glycosyltransferase polypeptides provided herein, which can be represented by an increase in specific activity (e.g., product produced/time/weight protein) or an increase in percent conversion of the substrate to the product (e.g., percent conversion of starting amount of substrate to product in a specified time period using a specified amount of glycosyltransferase) as compared to the reference glycosyltransferase enzyme. In some embodiments, the terms are used in reference to improved sucrose synthase enzymes provided herein. Exemplary methods to determine enzyme activity of the engineered glycosyltransferases and sucrose synthases of the present invention are provided in the Examples. Any property relating to enzyme activity may be affected, including the classical enzyme properties of $K_m$, $V_{max}$ or $k_{cat}$, changes of which can lead to increased enzymatic activity. For example, improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring glycosyltransferase or another engineered glycosyltransferase from which the glycosyltransferase polypeptides were derived.

As used herein, "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a glycosyltransferase polypeptide can be expressed as "percent conversion" of the substrate to the product in a specific period of time.

Enzymes with "generalist properties" (or "generalist enzymes") refer to enzymes that exhibit improved activity for a wide range of substrates, as compared to a parental sequence. Generalist enzymes do not necessarily demonstrate improved activity for every possible substrate. In some embodiments, the present invention provides glycosyltransferase variants with generalist properties, in that they demonstrate similar or improved activity relative to the parental gene for a wide range of sterically and electronically diverse substrates. In addition, the generalist enzymes provided herein were engineered to be improved across a wide range of diverse molecules to increase the production of metabolites/products.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., Nucl. Acids Res., 18:6409-6412 [1990] (erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, MA [1981]; and Wetmur, Crit. Rev. Biochem. Mol. Biol. 26:227-259 [1991]). In some embodiments, the polynucleotide encodes the polypeptide disclosed herein and hybridizes under defined conditions, such as moderately stringent or highly stringent conditions, to the complement of a sequence encoding an engineered glycosyltransferase enzyme of the present invention.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w/v) SDS at 65° C. and washing in 0.1×SSC containing 0.1% SDS at 65° C. Other high stringency hybridization conditions, as well as moderately stringent conditions, are described in the references cited above.

As used herein, "codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the glycosyltransferase enzymes may be codon optimized for optimal production in the host organism selected for expression.

As used herein, "preferred," "optimal," and "high codon usage bias" codons when used alone or in combination refer(s) interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; and Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli* and *Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

As used herein, "control sequence" includes all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

The phrase "suitable reaction conditions" refers to those conditions in the enzymatic conversion reaction solution (e.g., ranges of enzyme loading, substrate loading, temperature, pH, buffers, co-solvents, etc.) under which a glycosyltransferase polypeptide of the present invention is capable of converting a substrate to the desired product compound. Some exemplary "suitable reaction conditions" are provided herein.

As used herein, "loading," such as in "compound loading" or "enzyme loading" refers to the concentration or amount of a component in a reaction mixture at the start of the reaction.

As used herein, "substrate" in the context of an enzymatic conversion reaction process refers to the compound or molecule acted on by the engineered enzymes provided herein (e.g., engineered glycosyltransferase polypeptides).

As used herein, the terms "biomass," "biomass substrate," "cellulosic biomass," "cellulosic feedstock," and "cellulosic substrate" refer to any materials that contain cellulose. Biomass can be derived from plants, animals, or microorganisms, and may include, but is not limited to agricultural, industrial, and forestry residues, industrial and municipal wastes, and terrestrial and aquatic crops grown for energy purposes. Examples of cellulosic substrates include, but are not limited to, wood, wood pulp, paper pulp, corn fiber, corn grain, corn cobs, crop residues such as corn husks, corn stover, grasses, wheat, wheat straw, barley, barley straw, hay, rice, rice straw, switchgrass, waste paper, paper and pulp processing waste, woody or herbaceous plants, fruit or vegetable pulp, corn cobs, distillers grain, grasses, rice hulls, cotton, hemp, flax, sisal, sugar cane bagasse, sorghum, soy, switchgrass, components obtained from milling of grains, trees, branches, roots, leaves, wood chips, sawdust, shrubs and bushes, vegetables, fruits, and flowers and any suitable mixtures thereof. In some embodiments, the cellulosic biomass comprises, but is not limited to cultivated crops (e.g., grasses, including C4 grasses, such as switch grass, cord grass, rye grass, miscanthus, reed canary grass, or any combination thereof), sugar processing residues, for example, but not limited to, bagasse (e.g., sugar cane bagasse, beet pulp [e.g., sugar beet], or a combination thereof), agricultural residues (e.g., soybean stover, corn stover, corn fiber, rice straw, sugar cane straw, rice, rice hulls, barley straw, corn cobs, wheat straw, canola straw, oat straw, oat hulls, corn fiber, hemp, flax, sisal, cotton, or any combination thereof), fruit pulp, vegetable pulp, distillers' grains, forestry biomass (e.g., wood, wood pulp, paper pulp, recycled wood pulp fiber, sawdust, hardwood, such as aspen wood, softwood, or a combination thereof). Furthermore, in some embodiments, the cellulosic biomass comprises cellulosic waste material and/or forestry waste materials, including but not limited to, paper and pulp processing waste, newsprint, cardboard and the like. In some embodiments, the cellulosic biomass comprises one species of fiber, while in some alternative embodiments, the cellulosic biomass comprises a mixture of fibers that originate from different cellulosic biomasses. In some embodiments, the biomass may also comprise transgenic plants that express ligninase and/or cellulase enzymes (See e.g., US 2008/0104724, incorporated by reference herein).

As used herein, the term "slurry" refers to an aqueous solution in which are dispersed one or more solid components, such as a cellulosic substrate.

As used herein, "increasing" yield of a product (e.g., a steviol glycoside) from a reaction occurs when a particular component present during the reaction (e.g., a GH enzyme) causes more product to be produced, compared with a reaction conducted under the same conditions with the same substrate and other substituents, but in the absence of the component of interest.

As used herein, "hydrolyzing" cellulose or other polysaccharide occurs when at least some of the glycosidic bonds between two monosaccharides present in the substrate are hydrolyzed, thereby detaching from each other the two monomers that were previously bonded.

A reaction is said to be "substantially free" of a particular enzyme if the amount of that enzyme compared with other enzymes that participate in catalyzing the reaction is less than about 2%, about 1%, or about 0.1% (wt/wt).

As used herein, "fractionating" a liquid (e.g., a culture broth) means applying a separation process (e.g., salt precipitation, column chromatography, size exclusion, and filtration) or a combination of such processes to provide a solution in which a desired protein (e.g., rebaudiosides) comprises a greater percentage of total protein in the solution than in the initial liquid product.

As used herein, "starting composition" refers to any composition that comprises at least one substrate. In some embodiments, the starting composition comprises any cellulosic substrate.

In some alternative embodiments, the term "starting composition" refers to any composition comprising at least one steviol glycoside, wherein one or more of the steviol glycosides act as substrate(s) for a biotransformation. In some embodiments, the starting composition is provided as an aqueous solution. In some embodiments, the starting composition comprises at least one steviol glycoside selected from stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O, and synthetic steviol glycosides (e.g., enzymatically glucosylated steviol glycosides), In some embodiments, the starting composition comprises two or more steviol glycosides. In some embodiments, the starting composition comprises an extract obtained from purification of *Stevia rebaudiana* plant material (e.g., leaves). In some alternative embodiments, the starting composition comprises commercially available stevia extract(s). Additional starting compositions comprise by-products of processes used to isolate and purify steviol glycosides. In some embodiments, the starting composition comprises purified or partially purified steviol glycoside substrate(s). In some embodiments, the starting composition comprises greater than about 99% of a particular steviol glycoside by weight.

In some embodiments, the starting composition comprises at least one glycoside and a cellulosic component as the substrate to produce at least one steviol glycoside (e.g., rebaudioside A, D, etc.).

As used herein, "product" in the context of an enzymatic conversion process refers to the compound or molecule resulting from the action of an enzymatic polypeptide on a substrate. As used herein, in some embodiments, the term refers to the compound or molecule resulting from the action of the glycosyltransferase polypeptide on a substrate. In some embodiments, the product provided by the present invention is a steviol glycoside. In some embodiments, the product comprises at least one steviol glycoside selected from stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O, and synthetic steviol glycosides (e.g., enzymatically glucosylated steviol glycosides), As used herein the term "culturing" refers to the growing of a population of microbial cells under any suitable conditions (e.g., using a liquid, gel or solid medium).

Recombinant polypeptides can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference.

In some embodiments, the enzyme clones obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

After the variants are produced, they can be screened for any desired property (e.g., high or increased activity, or low or reduced activity, increased thermal activity, increased thermal stability, and/or acidic pH stability, etc.). In some embodiments, "recombinant glycosyltransferase polypeptides" (also referred to herein as "engineered glycosyltransferase polypeptides," "variant glycosyltransferase enzymes," "glycosyltransferase variants," and "glycosyltransferase combinatorial variants") find use. In some embodiments, "recombinant sucrose synthase polypeptides" (also referred to as "engineered sucrose synthase polypeptides," "variant sucrose synthase enzymes," "sucrose synthase variants," and "sucrose synthase combinatorial variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature. For example a "heterologous polynucleotide" is any polynucleotide that is introduced into a host cell by laboratory techniques, and includes polynucleotides that are removed from a host cell, subjected to laboratory manipulation, and then reintroduced into a host cell.

As used herein, the terms "host cell" and "host strain" refer to suitable hosts for expression vectors comprising DNA provided herein (e.g., the polynucleotides encoding the glycosyltransferase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess ("e.e.") calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess ("d.e."). Enantiomeric excess and diastereomeric excess are types of stereomeric excess.

As used herein, "regioselectivity" and "regioselective reaction" refer to a reaction in which one direction of bond making or breaking occurs preferentially over all other possible directions. Reactions can completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites.

As used herein, "thermostable" refers to a glycosyltransferase polypeptide that maintains similar activity (more than 60% to 80% for example) after exposure to elevated temperatures (e.g., 40-80° C.) for a period of time (e.g., 0.5-24 h) compared to the wild-type enzyme exposed to the same elevated temperature.

As used herein, "solvent stable" refers to a glycosyltransferase polypeptide that maintains similar activity (more than e.g., 60% to 80%) after exposure to varying concentrations (e.g., 5-99%) of solvent (ethanol, isopropyl alcohol, dimethylsulfoxide [DMSO], tetrahydrofuran, 2-methyltetrahydrofuran, acetone, toluene, butyl acetate, methyl tert-butyl ether, etc.) for a period of time (e.g., 0.5-24 h) compared to the wild-type enzyme exposed to the same concentration of the same solvent.

As used herein, "thermo- and solvent stable" refers to a glycosyltransferase polypeptide that is both thermostable and solvent stable.

As used herein, "reductant" refers to a compound or agent capable of converting $Fe^{+3}$ to $Fe^{+2}$. An exemplary reductant is ascorbic acid, which is generally in the form of L-ascorbic acid.

As used herein, "optional" and "optionally" mean that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups.

Glycosylation

Glycosylation can alter many properties of natural and synthetic products including stability, pharmacodynamics, solubility, and membrane transport. The present invention provides compositions, methods and enzymes suitable for generating new glycosylated compounds from various aglycone and glycosylated substrates. In some embodiments, the present invention provides means to efficiently generate known glycosylated compounds from easily obtained precursors. In some cases, glycosylation is achieved through chemical synthesis methods. However, these methods typically require undesirable chemicals and processes and can result in mixed products (e.g., with linkages in incorrect positions and/or with undesired anomeric configurations). Furthermore, carbohydrate chemistry requires multiple protection and deprotection steps.

In contrast, glycosylating enzymes can be active under mild conditions and can confer high positional selectivity and stereospecificity in a single step. Many naturally-occurring glycosylated metabolites are generated in vivo using glycosyltransferases that transfer sugar moieties from various sugar nucleosides. Many molecules, including many secondary metabolites with antimicrobial, antitumor, natural sweetness properties, etc., comprise non-ribosomal peptide, polyketide, or terpenoid backbones modified with β-glycosidic linkages. Many of the diterpene glycosides extracted from the plant, *Stevia rebaudiana* Bertoni, contain β-linked glucose molecules. Naturally, these molecules are glycosylated in vivo using UDP-glucose dependent glycosyl transferase enzymes. The present invention provides a method (See, FIG. 1), in which a new engineered glycosyltransferase is used to transfer the glucose moiety from a nucleoside diphosphoglucose to a substrate (e.g., rebaudioside D or stevioside), to produce one or more β-glucose linked products (e.g., rebaudioside M, rebaudioside A, or rebaudioside I). However, when used in vitro, the UDP-glucose can be prohibitively expensive and/or unavailable. In the some additional embodiments, a synthase (e.g., sucrose synthase or trehalose synthase) acts in the reverse direction to form a nucleoside diphosphoglucose compound from a nucleoside diphosphate and a glucose donor (e.g., sucrose, trehalose, or starch).

Thus, glycosylation finds use in the production of natural sweeteners, such as those derived from the sweet herb, *Stevia rebaudiana* Bertoni. As indicated above, this plant produces a number of diterpene glycosides which feature high intensity sweetness and sensory properties superior to those of many other high potency sweeteners. The above-mentioned sweet glycosides, have a common aglycone (i.e., steviol), and differ by the number and type of carbohydrate residues at the C13 and C19 positions. Steviol glycosides differ from each other not only in their molecular structure, but also by their taste properties. Usually, stevioside is reported to be 89-143 times sweeter than sucrose, while rebaudioside A is reported to be between 85 and 242 times sweeter than sucrose (See e.g., Kasai et al., Nippon Kagaku Kaishi, 1981:726-735 [1981]). Of these common compounds, rebaudioside A has the least astringent, the least bitter, and the least persistent aftertaste. Thus, it has the most favorable sensory attributes of the major steviol glycosides and has been commercialized. However, rebaudioside A only constitutes a smaller fraction (about 20%) of total glycosides isolated from *Stevia rebaudiana* Bertoni, with stevioside (about 70%) and minor steviol glycosides making up the rest (See e.g., FAO, Chemical and Technical Assessment, 63$^{rd}$ JECFA, Steviol Glycosides [2004]). The naturally occurring but even less abundant compound rebaudioside M, also known as rebaudioside X, is 200-350 times sweeter than sucrose and has a reduced aftertaste relative to rebaudioside A (See e.g., Prakash et al., Food, 3:162-175 [2014]). Thus, there is interest in the commercialization of rebaudioside M, for example as a natural sweetener, but currently no viable commercial route to synthesize this compound.

Engineered Glycosyltransferase Polypeptides

The present invention provides glycosyltransferase polypeptides, polynucleotides encoding the polypeptides, methods of preparing the polypeptides, and methods for using the polypeptides. Where the description relates to polypeptides, it is to be understood that it also describes the polynucleotides encoding the polypeptides. In some embodiments, the present invention provides engineered, non-naturally occurring GT enzymes with improved properties as compared to wild-type GT enzymes. Any suitable reaction conditions find use in the present invention. In some embodiments, methods are used to analyze the improved properties of the engineered polypeptides to carry out the transferase reaction. In some embodiments, the reaction conditions are modified with regard to concentrations or amounts of polypeptide, substrate, co-substrate, buffer, co-solvent, pH, conditions including temperature and reaction time, and/or conditions with the polypeptide immobilized on a solid support, as further described below and in the Examples.

In some embodiments, the engineered GT polypeptides described herein have improved properties as compared to wild-type GT enzymes such as in the conversion of steviol glycosides to further glycosylated steviol glycosides (e.g., stevioside to rebaudioside A or rebaudioside D to rebaudioside M) and in the use of adenine diphosphoglucose or other nucleoside diphosphates. In some embodiments, the engineered GT enzymes comprise amino acid sequences having one or more residue differences as compared to SEQ ID NO: 4, 8, 32, 232, 348, 548, 562, 696, 758, 770, 792, 954, 1002,1054, 2600, 2718, 2814, 2884, 3016, 3082, 3244, 3346, 3502, 3696, 4256, 4684, 4838, 4876, 5066, 5290, 5372, 5562, 5708, 5976, 6138, 6288, 6468, 684, 7388, and/or 8088. In some embodiments, the engineered GT enzymes are beta-1,2 glycosyltransferase variants having one or more residue differences as compared to SEQ ID NO: 758, 770, 792, 954, 1002, 1054, 2600, 2718, 2814, 2884, 3016, 3082, 3244, 3346, 3502, 3696, 3956, 4256, 4550, 7324, and/or 7784. In some embodiments, the engineered GT enzymes are beta-1,3 glycosyltransferase variants having one or more residue differences as compared to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, and/or 8088. In some further embodiments, engineered GT polypeptides are circular permuted proteins in which a peptide linker is incorporated at the genetic level between the N- and C-termini and new amino acid positions are selected as the location of the new N- and C-termini. In some embodiments, the circular permuted GT enzymes comprise amino acid sequences having one or more residue differences as compared to SEQ ID NO: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some embodiments, the circular permuted GT enzymes comprise amino acid sequences having one or more residue differences as compared to SEQ ID NO: 32. In some embodiments, the GT enzymes comprise at least one sequence set forth herein. In some embodiments, the present invention provides engineered glycosyltransferases comprising polypeptide sequences that have at least 90%, 91%, 92%, 93%, 94%, 95%, 96%, 97%, 98%, 99%, or more sequence identity to SEQ ID NOS: 6, 8, 10, 12, 14, 16, 18, 20, 22, 24, 26, 28, 30, 22, 34, 36, 38, 40, 42, 44, 46, 48, 50, 52, 54, 56, 58, 60, 62, 64, 66, 68, 70, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1290, 1292, 1294, 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656, 2658, 2660, 2662, 2664, 2666, 2668, 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, 2774, 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2830, 2932, 2934, 2936, 2938, 2940, 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, 3490, 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, 3652, 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, 3850, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, 3898, 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120, 4122, 4124, 4126, 4128, 4130, 4132, 4134, 4136, 4138, 4140, 4142, 4144, 4146, 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212, 4214, 4216, 4218, 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460, 4462, 4464, 4466, 4468, 4470, 4472, 4474, 4476, 4478, 4480, 4482, 4484, 4486, 4488, 4490, 4492, 4494, 4496, 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4640, 4642, 4644, 4646, 4648, 4650, 4652, 4654, 4656, 4658, 4660, 4662, 4664, 4666, 4668, 4670, 4672, 4674, 4676, 4678, 4680, 4682, 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4902, 4804, 4806, 4808, 4810, 4812, 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, 4874, 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, 5016, 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, 5260, 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, 5342, 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, 5542, 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, 5642, 5644, 5646, 5648, 5650, 5652, 5654, 5656, 5658, 5660, 5662, 5664, 5666, 5668, 5670, 5672, 5674, 5676, 5678, 5680, 5682, 5684, 5686, 5688, 5690, 5692, 5694, 5696, 5698, 5700, 5702, 5704, 5706, 5708, 5710, 5712, 5714, 5716, 5718, 5720, 5722, 5724, 5726, 5728, 5730, 5732, 5734, 5736, 5738, 5740, 5742, 5744, 5746, 5748, 5750, 5752, 5754, 5756, 5758, 5760, 5762, 5764, 5766, 5768, 5770, 5772, 5774, 5776, 5778, 5780, 5782, 5784, 5786, 5788, 5790, 5792, 5794, 5796, 5798, 5800, 5802, 5804, 5806, 5808, 5810, 5812, 5814, 5816, 5818, 5820, 5822, 5824, 5826, 5828, 5830, 5832, 5834, 5836, 5838, 5840, 5842, 5844, 5846, 5848, 5850, 5852, 5854, 5856, 5858, 5860, 5862, 5864, 5866, 5868, 5870, 5872, 5874, 5876, 5878, 5880, 5882, 5884, 5886, 5888, 5890, 5892, 5894, 5896, 5898, 5900, 5902, 5904, 5906, 5908, 5910, 5912, 5914, 5916, 5918, 5920, 5922, 5924, 5926, 5928, 5930, 5932, 5934, 5936, 5938, 5940, 5942, 5944, 5946, 5948, 5950, 5952, 5954, 5956, 5958, 5960, 5962, 5964, 5966, 5968, 5970, 5972, 5974, 5976, 5978, 5980, 5982, 5984, 5986, 5988, 5990, 5992, 5994, 5996, 5998, 6000, 6002, 6004, 6006, 6008, 6010, 6012, 6014, 6016, 6018, 6020, 6022, 6024, 6026, 6028, 6030, 6032, 6034, 6036, 6038, 6040, 6042, 6044, 6046, 6048, 6050, 6052, 6054, 6056, 6058, 6060, 6062, 6064, 6066, 6068, 6070, 6072, 6074, 6076, 6078, 6080, 6082, 6084, 6086, 6088, 6090, 6092, 6094, 6096, 6098, 6100, 6102, 6104, 6106, 6108, 6110, 6112, 6114, 6116, 6118, 6120, 6122, 6124, 6126, 6128, 6130, 6132, 6134, 6136, 6138, 6140, 6142, 6144, 6146, 6148, 6150, 6152, 6154, 6156, 6158, 6160, 6162, 6164, 6166, 6168, 6170, 6172, 6174, 6176, 6178, 6180, 6182, 6184, 6186, 6188, 6190, 6192, 6194, 6196, 6198, 6200, 6202, 6204, 6206, 6208, 6210, 6212, 6214, 6216, 6218, 6220, 6222, 6224, 6226, 6228, 6230, 6232, 6234, 6236, 6238, 6240, 6242, 6244, 6246, 6248, 6250, 6252, 6254, 6256, 6258, 6260, 6262, 6264, 6266, 6268, 6270, 6272, 6274, 6276, 6278, 6280, 6282, 6284, 6286, 6288, 6290, 6292, 6294, 6296, 6298, 6300, 6302, 6304, 6306, 6308, 6310, 6312, 6314, 6316, 6318, 6320, 6322, 6324, 6326, 6328, 6330, 6332, 6334, 6336, 6338, 6340, 6342, 6344, 6346, 6348, 6350, 6352, 6354, 6356, 6358, 6360, 6362, 6364, 6366, 6368, 6370, 6372, 6374, 6376, 6378, 6380, 6382, 6384, 6386, 6388, 6390, 6392, 6394, 6396, 6398, 6400, 6402, 6404, 6406, 6408, 6410, 6412, 6414, 6416, 6418, 6420, 6422, 6424, 6426, 6428, 6430, 6432, 6434, 6436, 6438, 6440, 6442, 6444, 6446, 6448, 6450, 6452, 6454, 6456, 6458, 6460, 6462, 6464, 6466, 6468, 6470, 6472, 6474, 6476, 6478, 6480, 6482, 6484, 6486, 6488, 6490, 6492, 6494, 6496, 6498, 6500, 6502, 6504, 6506, 6508, 6510, 6512, 6514, 6516, 6518, 6520, 6522, 6524, 6526, 6528, 6530, 6532, 6534, 6536, 6538, 6540, 6542, 6544, 6546, 6548, 6550, 6552, 6554, 6556, 6558, 6560, 6562, 6564, 6566, 6568, 6570, 6572, 6574, 6576, 6578, 6580, 6582, 6584, 6586, 6588, 6590, 6592, 6594, 6596, 6598, 6600, 6602, 6604, 6606, 6608, 6610, 6612, 6614, 6616, 6618, 6620, 6622, 6624, 6626, 6628, 6630, 6632, 6634, 6636, 6638, 6640, 6642, 6644, 6646, 6648, 6650, 6652, 6654, 6656, 6658, 6660, 6662, 6664, 6666, 6668, 6670, 6672, 6674, 6676, 6678, 6680, 6682, 6684, 6686, 6688, 6690, 6692, 6694, 6696, 6698, 6700, 6702, 6704, 6706, 6708, 6710, 6712, 6714, 6716, 6718, 6720, 6722, 6724, 6726, 6728, 6730, 6732, 6734, 6736, 6738, 6740, 6742, 6744, 6746, 6748, 6750, 6752, 6754, 6756, 6758, 6760, 6762, 6764, 6766, 6768, 6770, 6772, 6774, 6776, 6778, 6780, 6782, 6784, 6786, 6788, 6790, 6792, 6794, 6796, 6798, 6800, 6802, 6804, 6806, 6808, 6810, 6812, 6814, 6816, 6818, 6820, 6822, 6824, 6826, 6828, 6830, 6832, 6834, 6836, 6838, 6840, 6842, 6844, 6846, 6848, 6850, 6852, 6854, 6856, 6858, 6860, 6862, 6864, 6866, 6868, 6870, 6872, 6874, 6876, 6878, 6880, 6882, 6884, 6886, 6888, 6890, 6892, 6894, 6896, 6898, 6900, 6902, 6904, 6906, 6908, 6910, 6912, 6914, 6916, 6918, 6920, 6922, 6924, 6926, 6928, 6930, 6932, 6934, 6936, 6938, 6940, 6942, 6944, 6946, 6948, 6950, 6952, 6954, 6956, 6958, 6960, 6962, 6964, 6966, 6968, 6970, 6972, 6974, 6976, 6978, 6980, 6982, 6984, 6986, 6988, 6990, 6992, 6994, 6996, 6998, 7000, 7002, 7004, 7006, 7008, 7010, 7012, 7014, 7016, 7018, 7020, 7022, 7024, 7026, 7028, 7030, 7032, 7034, 7036, 7038, 7040, 7042, 7044, 7046, 7048, 7050, 7052, 7054, 7056, 7058, 7060, 7062, 7064, 7066, 7068, 7070, 7072, 7074, 7076, 7078, 7080, 7082, 7084, 7086, 7088, 7090, 7092, 7094, 7096, 7098, 7100, 7102, 7104, 7106, 7108, 7110, 7112, 7114, 7116, 7118, 7120, 7122, 7124, 7126, 7128, 7130, 7132, 7134, 7136, 7138, 7140, 7142, 7144, 7146, 7148, 7150, 7152, 7154, 7156, 7158, 7160, 7162, 7164, 7166, 7168, 7170, 7172, 7174, 7176, 7178, 7180, 7182, 7184, 7186, 7188, 7190, 7192, 7194, 7196, 7198, 7200, 7202, 7204, 7206, 7208, 7210, 7212, 7214, 7216, 7218, 7220, 7222, 7224, 7226, 7228, 7230, 7232, 7234, 7236, 7238, 7240, 7242, 7244, 7246, 7248, 7250, 7252, 7254, 7256, 7258, 7260, 7262, 7264, 7266, 7268, 7270, 7272, 7274, 7276, 7278, 7280, 7282, 7284, 7286, 7288, 7290, 7292, 7294, 7296, 7298, 7300, 7302, 7304, 7306, 7308, 7310, 7312, 7314, 7316, 7318, 7320, 7322, 7324, 7326, 7328, 7330, 7332, 7334, 7336, 7338, 7340, 7342, 7344, 7346, 7348, 7350, 7352, 7354, 7356, 7358, 7360, 7362, 7364, 7366, 7368, 7370, 7372, 7374, 7376, 7378, 7380, 7382, 7384, 7386, 7388, 7390, 7392, 7394, 7396, 7398, 7400, 7402, 7404, 7406, 7408, 7410, 7412, 7414, 7416, 7418, 7420, 7422, 7424, 7426, 7428, 7430, 7432, 7434, 7436, 7766, 7768, 7770, 7772, 7774, 7776, 7778, 7780, 7782, 7784, 7786, 7788, 7790, 7792, 7794, 7796, 7798, 7800, 7812, 7814, 7816, 7818, 7820, 7822, 7824, 7826, 7828, 7830, 7832, 7834, 7836, 7838, 7840, 7842, 7844, 7846, 7848, 7850, 7852, 7854, 7856, 7858, 7860, 7862, 7864, 7866, 7868, 7870, 7872, 7874, 7876, 7878, 7880, 7882, 7884, 7886, 7888, 7890, 7892, 7894, 7896, 7898, 7900, 7902, 7904, 7906, 7908, 7910, 7912, 7914, 7916, 7918, 7920, 7922, 7924, 7926, 7928, 7930, 7932, 7934, 7936, 7938, 7940, 7942, 7944, 7946, 7948, 7950, 7952, 7954, 7956, 7958, 7960, 7962, 7964, 7966, 7968, 7970, 7972, 7974, 7976, 7978, 7980, 7982, 7984, 7986, 7988, 7990, 7992, 7994, 7996, 7998, 8000, 8002, 8004, 8006, 8008, 8010, 8012, 8014, 8016, 8018, 8020, 8022, 8024, 8026, 8028, 8030, 8032, 8034, 8036, 8038, 8040, 8042, 8044, 8046, 8048, 8050, 8052, 8054, 8056, 8058, 8060, 8062, 8064, 8066, 8068, 8070, 8072, 8074, 8076, 8078, 8080, 8082, 8084, 8086, 8088, 8090, 8092, 8094, 8096, 8098, 8100, 8102, 8104, 8106, 8108, 8110, 8112, 8114, 8116, 8118, 8120, 8122, 8124, 8126, 8128, 8130, 8132, 8134, 8136, 8138, 8140, 8142, 8144, 8146, 8148, 8150, 8152, 8154, 8156, 8158, 8160, 8162, 8164, 8166, 8168, 8170, 8172, 8174, 8176, 8178, 8180, 8182, 8184, 8186, 8188, 8190, 8192, 8194, 8196, 8198, 8200, 8202, 8204, 8206, 8208, 8210, 8212, 8214, 8216, 8218, 8220, 8222, 8224, 8226, 8228, 8230, 8232, 8234, 8236, 8238, 8240, 8242, 8244, 8246, 8248, 8250, 8252, 8254, 8256, 8258, 8260, 8262, 8264, 8266, 8268, 8270, 8272, 8274, 8276, 8278, 8280, 8282, 8284, 8286, 8288, 8290, 8292, 8294, 8296, 8298, 8300, 8302, 8304, 8306, 8308, 8310, 8312, 8314, 8316, 8318, 8320, 8322, 8324, 8326, 8328, 8330, 8332, 8334, 8336, 8338, 8340, 8342, 8344, 8346, 8348, 8350, 8352, 8354, 8356, 8358, 8360, 8362, 8364, 8366, 8368, 8482, 8484, 8486, 8488, 8490, 8492, 8494, 8496, 8498, 8500, 8502, 8504, 8506, 8508, 8510, 8512, 8514, 8516, 8518, 8520, 8522, 8524, 8526, 8528, 8530, 8532, 8534, 8536, 8538, 8540, 8542, 8544, 8546, 8548, 8550, 8552, 8554, 8556, 8558, 8560, 8562, 8564, 8566, 8568, 8570, 8572, 8574, 8576, 8578, 8580, 8582, 8584, 8586, 8588, 8590, 8592, 8594, 8596, 8598, 8600, 8602, 8604, 8606, 8608, 8610, 8612, 8614, 8616, 8618, 8620, 8622, 8624, 8626, 8628, 8630, 8632, 8634, 8636, 8638, 8640, 8642, 8644, 8646, 8648, 8650, 8652, 8654, 8656, 8658, 8660, 8662, 8664, 8666, 8668, 8670, 8672, 8674, 8676, 8678, 8680, 8682, 8684, 8686, 8688, 8690, 8692, 8694, 8696, 8698, 8700, 8702, 8704, 8706, 8708, 8710, 8712, 8714, 8716, 8718, 8720, 8722, 8724, 8726, 8728, 8730, 8732, 8734, 8736, 8738, 8740, 8742, 8744, 8746, 8748, 8750, 8752, 8754, 8756, 8758, 8760, 8762, 8764, 8766, 8768, 8770, 8772, 8774, 8776, 8778, 8780, 8782, 8784, 8786, 8788, 8790, 8792, 8794, 8796, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, 9222, 9224, 9226, 9228, 9230, 9232, 9234, 9236, 9238, and/or 9240. In some additional embodiments, the present invention further provides engineered sucrose synthases comprising polypeptide sequences that have at least 90%, 91%, 92%, 93%, 94%, 95%, 96%, 97%, 98%, 99%, or more sequence identity to SEQ ID NOS:1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, 2594, 7438, 7440, 7442, 7444, 7446, 7448, 7450, 7452, 7454, 7456, 7458, 7460, 7462, 7464, 7466, 7468, 7470, 7472, 7474, 7476, 7478, 7480, 7482, 7484, 7486, 7488, 7490, 7492, 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558, 7560, 7562, 7564, 7566, 7568, 7570, 7572, 7574, 7576, 7578, 7580, 7582, 7584, 7586, 7588, 7590, 7592, 7594, 7596, 7598, 7600, 7602, 7604, 7606, 7608, 7610, 7612, 7614, 7616, 7618, 7620, 7622, 7624, 7626, 7628, 7630, 7632, 7634, 7636, 7638, 7640, 7642, 7644, 7646, 7648, 7650, 7652, 7654, 7656, 7658, 7660, 7662, 7664, 7666, 7668, 7670, 7672, 7674, 7676, 7678, 7680, 7682, 7684, 7686, 7688, 7690, 7692, 7694, 7696, 7698, 7700, 7702, 7704, 7706, 7708, 7710, 7712, 7714, 7716, 7718, 7720, 7722, 7724, 7726, 7728, 7730, 7732, 7734, 7736, 7738, 7740, 7742, 7744, 7746, 7748, 7750, 7752, 7754, 7756, 7758, 7760, 7762, 7764, 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442, 8444, 8446, 8448, 8450, 8452, 8454, 8456, 8458, 8460, 8462, 8464, 8466, 8468, 8470, 8472, 8474, 8476, 8478, 8480, 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, and 9106.

In some embodiments, additional reaction components or additional techniques are utilized to supplement the reaction conditions. In some embodiments, these include taking measures to stabilize or prevent inactivation of the enzyme, reduce product inhibition, shift reaction equilibrium to glucosylated product formation.

In some further embodiments, any of the above described process for the conversion of substrate compound to product compound can further comprise one or more steps selected from: extraction; isolation; purification; and crystallization, filtration, or lyophilization of product compound. Methods, techniques, and protocols for extracting, isolating, purifying, and/or crystallizing the glucosylated product from biocatalytic reaction mixtures produced by the above disclosed processes are known to the ordinary artisan and/or accessed through routine experimentation. Additionally, illustrative methods are provided in the Examples below.

Engineered Sucrose Synthase Polypeptides

The present invention provides engineered sucrose synthase (SuS) polypeptides, polynucleotides encoding the polypeptides, methods of preparing the polypeptides, and methods for using the polypeptides. Where the description relates to polypeptides, it is to be understood that it also describes the polynucleotides encoding the polypeptides. In some embodiments, the present invention provides engineered, non-naturally occurring SuS enzymes with improved properties as compared to wild-type SuS enzymes. Any suitable reaction conditions find use in the present invention. In some embodiments, methods are used to analyze the improved properties of the engineered polypeptides to carry out the synthase reaction. In some embodiments, the reaction conditions are modified with regard to concentrations or amounts of engineered SuS, substrate(s), buffer(s), solvent(s), pH, conditions including temperature and reaction time, and/or conditions with the engineered SuS polypeptide immobilized on a solid support, as further described below and in the Examples.

In some embodiments, the engineered SuS polypeptides described herein have improved properties as compared to wild-type SuS enzymes such as in the reactions described herein. In some embodiments, the engineered SuS enzymes comprise amino acid sequences having one or more residue differences as compared to SEQ ID NO: 74, 1080, 1158, 1222, 1392, 1456, 1582, 1764, 1804, 1840, 2064, 2432, 2510, 7506, and/or 8420.

In some embodiments, the present invention provides engineered SuS enzymes, wherein the polypeptide of the SuS enzymes comprise at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO:1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, 2594, 7438, 7440, 7442, 7444, 7446, 7448, 7450, 7452, 7454, 7456, 7458, 7460, 7462, 7464, 7466, 7468, 7470, 7472, 7474, 7476, 7478, 7480, 7482, 7484, 7486, 7488, 7490, 7492, 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558, 7560, 7562, 7564, 7566, 7568, 7570, 7572, 7574, 7576, 7578, 7580, 7582, 7584, 7586, 7588, 7590, 7592, 7594, 7596, 7598, 7600, 7602, 7604, 7606, 7608, 7610, 7612, 7614, 7616, 7618, 7620, 7622, 7624, 7626, 7628, 7630, 7632, 7634, 7636, 7638, 7640, 7642, 7644, 7646, 7648, 7650, 7652, 7654, 7656, 7658, 7660, 7662, 7664, 7666, 7668, 7670, 7672, 7674, 7676, 7678, 7680, 7682, 7684, 7686, 7688, 7690, 7692, 7694, 7696, 7698, 7700, 7702, 7704, 7706, 7708, 7710, 7712, 7714, 7716, 7718, 7720, 7722, 7724, 7726, 7728, 7730, 7732, 7734, 7736, 7738, 7740, 7742, 7744, 7746, 7748, 7750, 7752, 7754, 7756, 7758, 7760, 7762, 7764, 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442, 8444, 8446, 8448, 8450, 8452, 8454, 8456, 8458, 8460, 8462, 8464, 8466, 8468, 8470, 8472, 8474, 8476, 8478, 8480, 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, and 9106

In some embodiments, additional reaction components or additional techniques are utilized to supplement the reaction conditions. In some embodiments, these include taking measures to stabilize or prevent inactivation of the enzyme, reduce product inhibition, shift reaction equilibrium to glucosylated product formation.

In some further embodiments, any of the above described process for the conversion of substrate compound to product compound can further comprise one or more steps selected from: extraction, isolation, purification, crystallization, filtration, and/or lyophilization of product compound(s). Methods, techniques, and protocols for extracting, isolating, purifying, and/or crystallizing the product(s) (e.g., rebaudiosides) from biocatalytic reaction mixtures produced by the processes provided herein are known to the ordinary artisan and/or accessed through routine experimentation. Additionally, illustrative methods are provided in the Examples below.

Polynucleotides Encoding Engineered Polypeptides, Expression Vectors and Host Cells The present invention provides polynucleotides encoding the engineered enzyme polypeptides described herein. In some embodiments, the polynucleotides are operatively linked to one or more heterologous regulatory sequences that control gene expression to create a recombinant polynucleotide capable of expressing the polypeptide. In some embodiments, expression constructs containing at least one heterologous polynucleotide encoding the engineered enzyme polypeptide(s) is introduced into appropriate host cells to express the corresponding enzyme polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered enzyme (e.g., GT or SuS) polypeptide. Thus, the present invention provides methods and compositions for the production of each and every possible variation of enzyme polynucleotides that could be made that encode the enzyme polypeptides described herein by selecting combinations based on the possible codon choices, and all such variations are to be considered specifically disclosed for any polypeptide described herein, including the amino acid sequences presented in the Examples (e.g., in the various Tables).

In some embodiments, the codons are preferably optimized for utilization by the chosen host cell for protein production. For example, preferred codons used in bacteria are typically used for expression in bacteria. Consequently, codon optimized polynucleotides encoding the engineered enzyme polypeptides contain preferred codons at about 40%, 50%, 60%, 70%, 80%, 90%, or greater than 90% of the codon positions in the full length coding region.

In some embodiments, the enzyme polynucleotide encodes an engineered polypeptide having enzyme activity with the properties disclosed herein, wherein the polypeptide comprises an amino acid sequence having at least 60%, 65%, 70%, 75%, 80%, 85%, 86%, 87%, 88%, 89%, 90%, 91%, 92%, 93%, 94%, 95%, 96%, 97%, 98%, 99% or more identity to a reference sequence selected from the SEQ ID NOS provided herein, or the amino acid sequence of any variant (e.g., those provided in the Examples), and one or more residue differences as compared to the reference polynucleotide(s), or the amino acid sequence of any variant as disclosed in the Examples (for example 1, 2, 3, 4, 5, 6, 7, 8, 9, 10 or more amino acid residue positions). In some embodiments, the reference polypeptide sequence is selected from SEQ ID NOS: 4, 8, 32, 232, 348, 548, 562, 696, 758, 770, 792, 954, 1002, 1054, 2600, 2718, 2814, 2884, 3016, 3082, 3244, 3346, 3502, 3696, 3956, 4256, 4550, 4684, 4838, 4876, 5066, 5290, 5372, 5562, 5708, 5976, 6138, 6288, 6468, 6864, 7324, 7388, 7784, and/or 8088. In some alternative embodiments, the reference polypeptide sequence is selected from SEQ ID NOS: 74, 1080, 1158, 1222, 1392, 1456, 1582, 1764, 1804, 1840, 2064, 2432, 2510, 7506, and/or 8420.

In some embodiments, the reference polynucleotide sequence is selected from SEQ ID NOS: 3, 7, 31, 231, 347, 547, 561, 695, 757, 769, 791, 953, 1001, 1053, 2599, 2717, 2813, 2883, 3015, 3081, 3243, 3345, 3501, 3695, 3955, 4255, 4549, 4683, 4837, 4875, 5065, 5289, 5371, 5561, 5707, 5975, 6137, 6287, 6467, 6863, 7323, 7387, 7783, and/or 8087. In some embodiments, the reference polynucleotide sequence is selected from SEQ ID NOS: 757, 769, 791, 953, 1001, 1053, 2599, 2717, 2813, 2883, 3015, 3081, 3243, 3345, 3501, 3695, 3955, 4255, 4549, 7323, and/or 7783, while in some alternative embodiments, the reference polynucleotide sequence is selected from SEQ ID NOS: 3, 7, 31, 231, 347, 547, 561, 695, 4683, 4837, 4875, 5065, 5289, 5371, 5561, 5707, 5975, 6137, 6287, 6467, 6863, 7387, and/or 8087. In still some additional embodiments, the reference polynucleotide sequence is selected from SEQ ID NOS: 73, 1079, 1157, 1221, 1391, 1455, 1581, 1763, 1803, 1839, 2063, 2431, 2509, 7505, and/or 8419.

In some embodiments, the engineered polynucleotide encoding at least one engineered glycosyltransferase provided herein comprises at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO:5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1289, 1291, 1293, 2595, 2597, 2599, 2601, 2603, 2605, 2607, 2609, 2611, 2613, 2615, 2617, 2619, 2621, 2623, 2625, 2627, 2629, 2631, 2633, 2635, 2637, 2639, 2641, 2643, 2645, 2647, 2649, 2651, 2653, 2655, 2657, 2659, 2661, 2663, 2665, 2667, 2669, 2671, 2673, 2675, 2677, 2679, 2681, 2683, 2685, 2687, 2689, 2691, 2693, 2695, 2697, 2699, 2701, 2703, 2705, 2707, 2709, 2711, 2713, 2715, 2717, 2719, 2721, 2723, 2725, 2727, 2729, 2731, 2733, 2735, 2737, 2739, 2741, 2743, 2745, 2747, 2749, 2751, 2753, 2755, 2757, 2759, 2761, 2763, 2765, 2767, 2769, 2771, 2773, 2775, 2777, 2779, 2781, 2783, 2785, 2787, 2789, 2791, 2793, 2795, 2797, 2799, 2801, 2803, 2805, 2807, 2809, 2811, 2813, 2815, 2817, 2819, 2821, 2823, 2825, 2827, 2829, 2831, 2833, 2835, 2837, 2839, 2841, 2843, 2845, 2847, 2849, 2851, 2823, 2855, 2857, 2859, 2861, 2863, 2865, 2867, 2869, 2871, 2873, 2875, 2877, 2879, 2881, 2883, 2885, 2887, 2889, 2891, 2893, 2895, 2897, 2899, 2901, 2903, 2905, 2907, 2909, 2911, 2913, 2915, 2917, 2919, 2921, 2923, 2925, 2927, 2829, 2931, 2933, 2935, 2937, 2939, 2941, 2943, 2945, 2947, 2949, 2951, 2953, 2955, 2957, 2959, 2961, 2963, 2965, 2967, 2969, 2971, 2973, 2975, 2977, 2979, 2981, 2983, 2985, 2987, 2989, 2991, 2993, 2995, 2997, 2999, 3001, 3003, 3005, 3007, 3009, 3011, 3013, 3015, 3017, 3019, 3021, 3023, 3025, 3027, 3029, 3031, 3033, 3035, 3037, 3039, 3041, 3043, 3045, 3047, 3049, 3051, 3053, 3055, 3057, 3059, 3061, 3063, 3065, 3067, 3069, 3071, 3073, 3075, 3077, 3079, 3081, 3083, 3085, 3087, 3089, 3091, 3093, 3095, 3097, 3099, 3101, 3103, 3105, 3107, 3109, 3111, 3113, 3115, 3117, 3119, 3121, 3123, 3125, 3127, 3129, 3131, 3133, 3135, 3137, 3139, 3141, 3143, 3145, 3147, 3149, 3151, 3153, 3155, 3157, 3159, 3161, 3163, 3165, 3167, 3169, 3171, 3173, 3175, 3177, 3179, 3181, 3183, 3185, 3187, 3189, 3191, 3193, 3195, 3197, 3199, 3201, 3203, 3205, 3207, 3209, 3211, 3213, 3215, 3217, 3219, 3221, 3223, 3225, 3227, 3229, 3231, 3233, 3235, 3237, 3239, 3241, 3243, 3245, 3247, 3249, 3251, 3253, 3255, 3257, 3259, 3261, 3263, 3265, 3267, 3269, 3271, 3273, 3275, 3277, 3279, 3281, 3283, 3285, 3287, 3289, 3291, 3293, 3295, 3297, 3299, 3301, 3303, 3305, 3307, 3309, 3311, 3313, 3315, 3317, 3319, 3321, 3323, 3325, 3327, 3329, 3331, 3333, 3335, 3337, 3339, 3341, 3343, 3345, 3347, 3349, 3351, 3353, 3355, 3357, 3359, 3361, 3363, 3365, 3367, 3369, 3371, 3373, 3375, 3377, 3379, 3381, 3383, 3385, 3387, 3389, 3391, 3393, 3395, 3397, 3399, 3401, 3403, 3405, 3407, 3409, 3411, 3413, 3415, 3417, 3419, 3421, 3423, 3425, 3427, 3429, 3431, 3433, 3435, 3437, 3439, 3441, 3443, 3445, 3447, 3449, 3451, 3453, 3455, 3457, 3459, 3461, 3463, 3465, 3467, 3469, 3471, 3473, 3475, 3477, 3479, 3481, 3483, 3485, 3487, 3489, 3491, 3493, 3495, 3497, 3499, 3501, 3503, 3505, 3507, 3509, 3511, 3513, 3515, 3517, 3519, 3521, 3523, 3525, 3527, 3529, 3531, 3533, 3535, 3537, 3539, 3541, 3543, 3545, 3547, 3549, 3551, 3553, 3555, 3557, 3559, 3561, 3563, 3565, 3567, 3569, 3571, 3573, 3575, 3577, 3579, 3581, 3583, 3585, 3587, 3589, 3591, 3593, 3595, 3597, 3599, 3601, 3603, 3605, 3607, 3609, 3611, 3613, 3615, 3617, 3619, 3621, 3623, 3625, 3627, 3629, 3631, 3633, 3635, 3637, 3639, 3641, 3643, 3645, 3647, 3649, 3651, 3653, 3655, 3657, 3659, 3661, 3663, 3665, 3667, 3669, 3671, 3673, 3675, 3677, 3679, 3681, 3683, 3685, 3687, 3689, 3691, 3693, 3695, 3697, 3699, 3791, 3703, 3705, 3707, 3709, 3711, 3713, 3715, 3717, 3719, 3721, 3723, 3725, 3727, 3729, 3731, 3733, 3735, 3737, 3739, 3741, 3743, 3745, 3747, 3749, 3751, 3753, 3755, 3757, 3759, 3761, 3763, 3765, 3767, 3769, 3771, 3773, 3775, 3777, 3779, 3781, 3783, 3785, 3787, 3789, 3791, 3793, 3795, 3797, 3799, 3801, 3803, 3805, 3807, 3809, 3811, 3813, 3815, 3817, 3819, 3821, 3823, 3825, 3827, 3829, 3831, 3833, 3835, 3837, 3839, 3841, 3843, 3845, 3847, 3849, 3851, 3853, 3855, 3857, 3859, 3861, 3863, 3865, 3867, 3869, 3871, 3873, 3875, 3877, 3879, 3881, 3883, 3885, 3887, 3889, 3891, 3893, 3895, 3897, 3899, 3901, 3903, 3905, 3907, 3909, 3911, 3913, 3915, 3917, 3919, 3921, 3923, 3925, 3927, 3929, 3931, 3933, 3935, 3937, 3939, 3941, 3943, 3945, 3947, 3949, 3951, 3953, 3955, 3957, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, 4021, 4023, 4025, 4027, 4029, 4031, 4033, 4035, 4037, 4039, 4041, 4043, 4045, 4047, 4049, 4051, 4053, 4055, 4057, 4059, 4061, 4063, 4065, 4067, 4069, 4071, 4073, 4075, 4077, 4079, 4081, 4083, 4085, 4087, 4089, 4091, 4093, 4095, 4097, 4099, 4101, 4103, 4105, 4107, 4109, 4111, 4113, 4115, 4117, 4119, 4121, 4123, 4125, 4127, 4129, 4131, 4133, 4135, 4137, 4139, 4141, 4143, 4145, 4147, 4149, 4151, 4153, 4155, 4157, 4159, 4161, 4163, 4165, 4167, 4169, 4171, 4173, 4175, 4177, 4179, 4181, 4183, 4185, 4187, 4189, 4191, 4193, 4195, 4197, 4199, 4201, 4203, 4205, 4207, 4209, 4211, 4213, 4215, 4217, 4219, 4221, 4223, 4225, 4227, 4229, 4231, 4233, 4235, 4237, 4239, 4241, 4243, 4245, 4247, 4249, 4251, 4253, 4255, 4257, 4259, 4261, 4263, 4265, 4267, 4269, 4271, 4273, 4275, 4277, 4279, 4281, 4283, 4285, 4287, 4289, 4291, 4293, 4295, 4297, 4299, 4301, 4303, 4305, 4307, 4309, 4311, 4313, 4315, 4317, 4319, 4321, 4323, 4325, 4327, 4329, 4331, 4333, 4335, 4337, 4339, 4341, 4343, 4345, 4347, 4349, 4351, 4353, 4355, 4357, 4359, 4361, 4363, 4365, 4367, 4369, 4371, 4373, 4375, 4377, 4379, 4381, 4383, 4385, 4387, 4389, 4391, 4393, 4395, 4397, 4399, 4401, 4403, 4405, 4407, 4409, 4411, 4413, 4415, 4417, 4419, 4421, 4423, 4425, 4427, 4429, 4431, 4433, 4435, 4437, 4439, 4441, 4443, 4445, 4447, 4449, 4451, 4453, 4455, 4457, 4459, 4461, 4463, 4465, 4467, 4469, 4471, 4473, 4475, 4477, 4479, 4481, 4483, 4485, 4487, 4489, 4491, 4493, 4495, 4497, 4499, 4501, 4503, 4505, 4507, 4509, 4511, 4513, 4515, 4517, 4519, 4521, 4523, 4525, 4527, 4529, 4531, 4533, 4535, 4537, 4539, 4541, 4543, 4545, 4547, 4549, 4551, 4553, 4555, 4557, 4559, 4561, 4563, 4565, 4567, 4569, 4571, 4573, 4575, 4577, 4579, 4581, 4583, 4585, 4587, 4589, 4591, 4593, 4595, 4597, 4599, 4601, 4603, 4605, 4607, 4609, 4611, 4613, 4615, 4617, 4619, 4621, 4623, 4625, 4627, 4629, 4631, 4633, 4635, 4637, 4639, 4641, 4643, 4645, 4647, 4649, 4651, 4653, 4655, 4657, 4659, 4661, 4663, 4665, 4667, 4669, 4671, 4673, 4675, 4677, 4679, 4681, 4683, 4685, 4687, 4689, 4691, 4693, 4695, 4697, 4699, 4701, 4703, 4705, 4707, 4709, 4711, 4713, 4715, 4717, 4719, 4721, 4723, 4725, 4727, 4729, 4731, 4733, 4735, 4737, 4739, 4741, 4743, 4745, 4747, 4749, 4751, 4753, 4755, 4757, 4759, 4761, 4763, 4765, 4767, 4769, 4771, 4773, 4775, 4777, 4779, 4781, 4783, 4785, 4787, 4789, 4791, 4793, 4795, 4797, 4799, 4801, 4803, 4805, 4807, 4809, 4811, 4813, 4815, 4817, 4819, 4821, 4823, 4825, 4827, 4829, 4831, 4833, 4835, 4837, 4839, 4841, 4843, 4845, 4847, 4849, 4851, 4853, 4855, 4857, 4859, 4861, 4863, 4865, 4867, 4869, 4871, 4873, 4875, 4877, 4879, 4881, 4883, 4885, 4887, 4889, 4891, 4893, 4895, 4897, 4899, 4901, 4903, 4905, 4907, 4909, 4911, 4913, 4915, 4917, 4919, 4921, 4923, 4925, 4927, 4929, 4931, 4933, 4935, 4937, 4939, 4941, 4943, 4945, 4947, 4949, 4951, 4953, 4955, 4957, 4959, 4961, 4963, 4965, 4967, 4969, 4971, 4973, 4975, 4977, 4979, 4981, 4983, 4985, 4987, 4989, 4991, 4993, 4995, 4997, 4999, 5001, 5003, 5005, 5007, 5009, 5011, 5013, 5015, 5017, 5019, 5021, 5023, 5025, 5027, 5029, 5031, 5033, 5035, 5037, 5039, 5041, 5043, 5045, 5047, 5059, 5051, 5053, 5055, 5057, 5059, 5061, 5063, 5065, 5067, 5069, 5071, 5073, 5075, 5077, 5079, 5081, 5083, 5085, 5087, 5089, 5091, 5093, 5095, 5097, 5099, 5101, 5103, 5105, 5107, 5109, 5111, 5113, 5115, 5117, 5119, 5121, 5123, 5125, 5127, 5129, 5131, 5133, 5135, 5137, 5139, 5141, 5143, 5145, 5147, 5149, 5151, 5153, 5155, 5157, 5159, 5161, 5163, 5165, 5167, 5169, 5171, 5173, 5175, 5177, 5179, 5181, 5183, 5185, 5187, 5189, 5191, 5193, 5195, 5197, 5199, 5201, 5203, 5205, 5207, 5209, 5211, 5213, 5215, 5217, 5219, 5221, 5223, 5225, 5227, 5229, 5231, 5233, 5235, 5237, 5239, 5241, 5243, 5245, 5247, 5249, 5251, 5253, 5255, 5257, 5259, 5261, 5263, 5265, 5267, 5269, 5271, 5273, 5275, 5277, 5279, 5281, 5283, 5285, 5287, 5289, 5291, 5293, 5295, 5297, 5299, 5301, 5303, 5305, 5307, 5309, 5311, 5313, 5315, 5317, 5319, 5321, 5323, 5325, 5327, 5329, 5331, 5333, 5335, 5337, 5339, 5341, 5343, 5345, 5347, 5349, 5351, 5353, 5355, 5357, 5359, 5361, 5363, 5365, 5367, 5369, 5371, 5373, 5375, 5377, 5379, 5381, 5383, 5385, 5387, 5389, 5391, 5393, 5395, 5397, 5399, 5401, 5403, 5405, 5407, 5409, 5411, 5413, 5415, 5417, 5419, 5421, 5423, 5425, 5427, 5429, 5431, 5433, 5435, 5437, 5439, 5441, 5443, 5445, 5447, 5449, 5451, 5453, 5455, 5457, 5459, 5461, 5463, 5465, 5467, 5469, 5471, 5473, 5475, 5477, 5479, 5481, 5483, 5485, 5487, 5489, 5491, 5493, 5495, 5497, 5499, 5501, 5503, 5505, 5507, 5509, 5511, 5513, 5515, 5517, 5519, 5521, 5523, 5525, 5527, 5529, 5531, 5533, 5535, 5537, 5539, 5541, 5543, 5545, 5547, 5549, 5551, 5553, 5555, 5557, 5559, 5561, 5563, 5565, 5567, 5569, 5571, 5573, 5575, 5577, 5579, 5581, 5583, 5585, 5587, 5589, 5591, 5593, 5595, 5597, 5599, 5601, 5603, 5605, 5607, 5609, 5611, 5613, 5615, 5617, 5619, 5621, 5623, 5625, 5627, 5629, 5631, 5633, 5635, 5637, 5639, 5641, 5643, 5645, 5647, 5649, 5651, 5653, 5655, 5657, 5659, 5661, 5663, 5665, 5667, 5669, 5671, 5673, 5675, 5677, 5679, 5681, 5683, 5685, 5687, 5689, 5691, 5693, 5695, 5697, 5699, 5701, 5703, 5705, 5707, 5709, 5711, 5713, 5715, 5717, 5719, 5721, 5723, 5725, 5727, 5729, 5731, 5733, 5735, 5737, 5739, 5741, 5743, 5745, 5747, 5749, 5751, 5753, 5755, 5757, 5759, 5761, 5763, 5765, 5767, 5769, 5771, 5773, 5775, 5777, 5779, 5781, 5783, 5785, 5787, 5789, 5791, 5793, 5795, 5797, 5799, 5801, 5803, 5805, 5807, 5809, 5811, 5813, 5815, 5817, 5819, 5821, 5823, 5825, 5827, 5829, 5831, 5833, 5835, 5837, 5839, 5841, 5843, 5845, 5847, 5849, 5851, 5853, 5855, 5857, 5859, 5861, 5863, 5865, 5867, 5869, 5871, 5873, 5875, 5877, 5879, 5881, 5883, 5885, 5887, 5889, 5891, 5893, 5895, 5897, 5899, 5901, 5903, 5905, 5907, 5909, 5911, 5913, 5915, 5917, 5919, 5921, 5923, 5925, 5927, 5929, 5931, 5933, 5935, 5937, 5939, 5941, 5943, 5945, 5947, 5949, 5951, 5953, 5955, 5957, 5959, 5961, 5963, 5965, 5967, 5969, 5971, 5973, 5975, 5977, 5979, 5981, 5983, 5985, 5987, 5989, 5991, 5993, 5995, 5997, 5999, 6001, 6003, 6005, 6007, 6009, 6011, 6013, 6015, 6017, 6019, 6021, 6023, 6025, 6027, 6029, 6031, 6033, 6035, 6037, 6039, 6041, 6043, 6045, 6047, 6049, 6051, 6053, 6055, 6057, 6059, 6061, 6063, 6065, 6067, 6069, 6071, 6073, 6075, 6077, 6079, 6081, 6083, 6085, 6087, 6089, 6091, 6093, 6095, 6097, 6099, 6101, 6103, 6105, 6107, 6109, 6111, 6113, 6115, 6117, 6119, 6121, 6123, 6125, 6127, 6129, 6131, 6133, 6135, 6137, 6139, 6141, 6143, 6145, 6147, 6149, 6151, 6153, 6155, 6157, 6159, 6161, 6163, 6165, 6167, 6169, 6171, 6173, 6175, 6177, 6179, 6181, 6183, 6185, 6187, 6189, 6191, 6193, 6195, 6197, 6199, 6201, 6203, 6205, 6207, 6209, 6211, 6213, 6215, 6217, 6219, 6221, 6223, 6225, 6227, 6229, 6231, 6233, 6235, 6237, 6239, 6241, 6243, 6245, 6247, 6249, 6251, 6253, 6255, 6257, 6259, 6261, 6263, 6265, 6267, 6269, 6271, 6273, 6275, 6277, 6279, 6281, 6283, 6285, 6287, 6289, 6291, 6293, 6295, 6297, 6299, 6301, 6303, 6305, 6307, 6309, 6311, 6313, 6315, 6317, 6319, 6321, 6323, 6325, 6327, 6329, 6331, 6333, 6335, 6337, 6339, 6341, 6343, 6345, 6347, 6349, 6351, 6353, 6355, 6357, 6359, 6361, 6363, 6365, 6367, 6369, 6371, 6373, 6375, 6377, 6379, 6381, 6383, 6385, 6387, 6389, 6391, 6393, 6395, 6397, 6399, 6401, 6403, 6405, 6407, 6409, 6411, 6413, 6415, 6417, 6419, 6421, 6423, 6425, 6427, 6429, 6431, 6433, 6435, 6437, 6439, 6441, 6443, 6445, 6447, 6449, 6451, 6453, 6455, 6457, 6459, 6461, 6463, 6465, 6467, 6469, 6471, 6473, 6475, 6477, 6479, 6481, 6483, 6485, 6487, 6489, 6491, 6493, 6495, 6497, 6499, 6501, 6503, 6505, 6507, 6509, 6511, 6513, 6515, 6517, 6519, 6521, 6523, 6525, 6527, 6529, 6531, 6533, 6535, 6537, 6539, 6541, 6543, 6545, 6547, 6549, 6551, 6553, 6555, 6557, 6559, 6561, 6563, 6565, 6567, 6569, 6571, 6573, 6575, 6577, 6579, 6581, 6583, 6585, 6587, 6589, 6591, 6593, 6595, 6597, 6599, 6601, 6603, 6605, 6607, 6609, 6611, 6613, 6615, 6617, 6619, 6621, 6623, 6625, 6627, 6629, 6631, 6633, 6635, 6637, 6639, 6641, 6643, 6645, 6647, 6649, 6651, 6653, 6655, 6657, 6659, 6661, 6663, 6665, 6667, 6669, 6671, 6673, 6675, 6677, 6679, 6681, 6683, 6685, 6687, 6689, 6691, 6693, 6695, 6697, 6699, 6701, 6703, 6705, 6707, 6709, 6711, 6713, 6715, 6717, 6719, 6721, 6723, 6725, 6727, 6729, 6731, 6733, 6735, 6737, 6739, 6741, 6743, 6745, 6747, 6749, 6751, 6753, 6755, 6757, 6759, 6761, 6763, 6765, 6767, 6769, 6771, 6773, 6775, 6777, 6779, 6781, 6783, 6785, 6787, 6789, 6791, 6793, 6795, 6797, 6799, 6801, 6803, 6805, 6807, 6809, 6811, 6813, 6815, 6817, 6819, 6821, 6823, 6825, 6827, 6829, 6831, 6833, 6835, 6837, 6839, 6841, 6843, 6845, 6847, 6849, 6851, 6853, 6855, 6857, 6859, 6861, 6863, 6865, 6867, 6869, 6871, 6873, 6875, 6877, 6879, 6881, 6883, 6885, 6887, 6889, 6891, 6893, 6895, 6897, 6899, 6901, 6903, 6905, 6907, 6909, 6911, 6913, 6915, 6917, 6919, 6921, 6923, 6925, 6927, 6929, 6931, 6933, 6935, 6937, 6939, 6941, 6943, 6945, 6947, 6949, 6951, 6953, 6955, 6957, 6959, 6961, 6963, 6965, 6967, 6969, 6971, 6973, 6975, 6977, 6979, 6981, 6983, 6985, 6987, 6989, 6991, 6993, 6995, 6997, 6999, 7001, 7003, 7005, 7007, 7009, 7011, 7013, 7015, 7017, 7019, 7021, 7023, 7025, 7027, 7029, 7031, 7033, 7035, 7037, 7039, 7041, 7043, 7045, 7047, 7049, 7051, 7053, 7055, 7057, 7059, 7061, 7063, 7065, 7067, 7069, 7071, 7073, 7075, 7077, 7079, 7081, 7083, 7085, 7087, 7089, 7091, 7093, 7095, 7097, 7099, 7101, 7103, 7105, 7107, 7109, 7111, 7113, 7115, 7117, 7119, 7121, 7123, 7125, 7127, 7129, 7131, 7133, 7135, 7137, 7139, 7141, 7143, 7145, 7147, 7149, 7151, 7153, 7155, 7157, 7159, 7161, 7163, 7165, 7167, 7169, 7171, 7173, 7175, 7177, 7179, 7181, 7183, 7185, 7187, 7189, 7191, 7193, 7195, 7197, 7199, 7201, 7203, 7205, 7207, 7209, 7211, 7213, 7215, 7217, 7219, 7221, 7223, 7225, 7227, 7229, 7231, 7233, 7235, 7237, 7239, 7241, 7243, 7245, 7247, 7249, 7251, 7253, 7255, 7257, 7259, 7261, 7263, 7265, 7267, 7269, 7271, 7273, 7275, 7277, 7279, 7281, 7283, 7285, 7287, 7289, 7291, 7293, 7295, 7297, 7299, 7301, 7303, 7305, 7307, 7309, 7311, 7313, 7315, 7317, 7319, 7321, 7323, 7325, 7327, 7329, 7331, 7333, 7335, 7337, 7339, 7341, 7343, 7345, 7347, 7349, 7351, 7353, 7355, 7357, 7359, 7361, 7363, 7365, 7367, 7369, 7371, 7373, 7375, 7377, 7379, 7381, 7383, 7385, 7387, 7389, 7391, 7393, 7395, 7397, 7399, 7401, 7403, 7405, 7407, 7409, 7411, 7413, 7415, 7417, 7419, 7421, 7423, 7425, 7427, 7429, 7431, 7433, 7435, 7765, 7767, 7769, 7771, 7773, 7775, 7777, 7779, 7781, 7783, 7785, 7787, 7789, 7791, 7793, 7795, 7797, 7799, 7811, 7813, 7815, 7817, 7819, 7821, 7823, 7825, 7827, 7829, 7831, 7833, 7835, 7837, 7839, 7841, 7843, 7845, 7847, 7849, 7851, 7853, 7855, 7857, 7859, 7861, 7863, 7865, 7867, 7869, 7871, 7873, 7875, 7877, 7879, 7881, 7883, 7885, 7887, 7889, 7891, 7893, 7895, 7897, 7899, 7901, 7903, 7905, 7907, 7909, 7911, 7913, 7915, 7917, 7919, 7921, 7923, 7925, 7927, 7929, 7931, 7933, 7935, 7937, 7939, 7941, 7943, 7945, 7947, 7949, 7951, 7953, 7955, 7957, 7959, 7961, 7963, 7965, 7967, 7969, 7971, 7973, 7975, 7977, 7979, 7981, 7983, 7985, 7987, 7989, 7991, 7993, 7995, 7997, 7999, 8001, 8003, 8005, 8007, 8009, 8011, 8013, 8015, 8017, 8019, 8021, 8023, 8025, 8027, 8029, 8031, 8033, 8035, 8037, 8039, 8041, 8043, 8045, 8047, 8049, 8051, 8053, 8055, 8057, 8059, 8061, 8063, 8065, 8067, 8069, 8071, 8073, 8075, 8077, 8079, 8081, 8083, 8085, 8087, 8089, 8091, 8093, 8095, 8097, 8099, 8101, 8103, 8105, 8107, 8109, 8111, 8113, 8115, 8117, 8119, 8121, 8123, 8125, 8127, 8129, 8131, 8133, 8135, 8137, 8139, 8141, 8143, 8145, 8147, 8149, 8151, 8153, 8155, 8157, 8159, 8161, 8163, 8165, 8167, 8169, 8171, 8173, 8175, 8177, 8179, 8181, 8183, 8185, 8187, 8189, 8191, 8193, 8195, 8197, 8199, 8201, 8203, 8205, 8207, 8209, 8211, 8213, 8215, 8217, 8219, 8221, 8223, 8225, 8227, 8229, 8231, 8233, 8235, 8237, 8239, 8241, 8243, 8245, 8247, 8249, 8251, 8253, 8255, 8257, 8259, 8261, 8263, 8265, 8267, 8269, 8271, 8273, 8275, 8277, 8279, 8281, 8283, 8285, 8287, 8289, 8291, 8293, 8295, 8297, 8299, 8301, 8303, 8305, 8307, 8309, 8311, 8313, 8315, 8317, 8319, 8321, 8323, 8325, 8327, 8329, 8331, 8333, 8335, 8337, 8339, 8341, 8343, 8345, 8347, 8349, 8351, 8353, 8355, 8357, 8359, 8361, 8363, 8365, 8367, 8481, 8483, 8485, 8487, 8489, 8491, 8493, 8495, 8497, 8489, 8501, 8503, 8505, 8507, 8509, 8511, 8513, 8515, 8517, 8519, 8521, 8523, 8525, 8527, 8529, 8531, 8533 8535, 8537, 8539, 8541, 8543, 8545, 8547, 8549, 8551, 8553, 8555, 8557, 8559, 8561, 8563, 8565, 8567, 8569, 8571, 8573, 8575, 8577, 8579, 8581, 8583, 8585, 8587, 8589, 8591, 8593, 8595, 8597, 8599, 8601, 8603, 8605, 8607, 8609, 8611, 8613, 8615, 8617, 8619, 8621, 8623, 8625, 8627, 8629, 8631, 8633, 8635, 8637, 8639, 8641, 8643, 8645, 8647, 8649, 8651, 8653, 8655, 8657, 8659, 8661, 8663, 8665, 8667, 8669, 8671, 8673, 8675, 8677, 8679, 8681, 8683, 8685, 8687, 8689, 8691, 8693, 8695, 8697, 8699, 8701, 8703, 8705, 8707, 8709, 8711, 8713, 8715, 8717, 8719, 8721, 8723, 8725, 8727, 8729, 8731, 8733, 8735, 8737, 8739, 8741, 8743, 8745, 8747, 8749, 8751, 8753, 8755, 8757, 8759, 8761, 8763, 8765, 8767, 8769, 8771, 8773, 8775, 8777, 8779, 8781, 8783, 8785, 8787, 8789, 8791, 8793, 8795, 9107, 9109, 9111, 9113, 9115, 9117, 9119, 9121, 9123, 9125, 9127, 9129, 9131, 9133, 9135, 9137, 9139, 9141, 9143, 9145, 9147, 9149, 9151, 9153, 9155, 9157, 9159, 9161, 9163, 9165, 9167, 9169, 9171, 9173, 9175, 9177, 9179, 9181, 9183, 9185, 9187, 9189, 9191, 9193, 9195, 9197, 9199, 9201, 9203, 9205, 9207, 9209, 9211, 9213, 9215, 9217, 9219, 9221, 9223, 9225, 9227, 9229, 9231, 9233, 9235, 9237, and/or 9239.

In some additional embodiments, the engineered polynucleotide encoding at least one engineered sucrose synthase provided herein comprises at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to SEQ ID NO:1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1847, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219, 2221, 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2413, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543, 2545, 2547, 2549, 2551, 2553, 2555, 2557, 2559, 2561, 2563, 2565, 2567, 2569, 2571, 2573, 2575, 2577, 2579, 2581, 2583, 2585, 2587, 2589, 2591, 2593, 7437, 7439, 7441, 7443, 7445, 7447, 7449, 7451, 7453, 7455, 7457, 7459, 7461, 7463, 7465, 7467, 7469, 7471, 7473, 7475, 7477, 7479, 7481, 7483, 7485, 7487, 7489, 7491, 7493, 7495, 7497, 7499, 7501, 7503, 7505, 7507, 7509, 7511, 7513, 7515, 7517, 7519, 7521, 7523, 7525, 7527, 7529, 7531, 7533, 7535, 7537, 7539, 7541, 7543, 7545, 7547, 7549, 7551, 7553, 7555, 7557, 7559, 7561, 7563, 7565, 7567, 7569, 7571, 7573, 7575, 7577, 7579, 7581, 7583, 7585, 7587, 7589, 7591, 7593, 7595, 7597, 7599, 7601, 7603, 7605, 7607, 7609, 7611, 7613, 7615, 7617, 7619, 7621, 7623, 7625, 7627, 7629, 7631, 7633, 7635, 7637, 7639, 7641, 7643, 7645, 7647, 7649, 7651, 7653, 7655, 7657, 7659, 7661, 7663, 7665, 7667, 7669, 7671, 7673, 7675, 7677, 7679, 7681, 7683, 7685, 7687, 7689, 7691, 7693, 7695, 7697, 7699, 7701, 7703, 7705, 7707, 7709, 7711, 7713, 7715, 7717, 7719, 7721, 7723, 7725, 7727, 7729, 7731, 7733, 7735, 7737, 7739, 7741, 7743, 7745, 7747, 7749, 7751, 7753, 7755, 7757, 7759, 7761, 7763, 8369, 8371, 8373, 8375, 8377, 8379, 8381, 8383, 8385, 8387, 8389, 8391, 8393, 8395, 8397, 8399, 8401, 8403, 8405, 8407, 8409, 8411, 8413, 8415, 8417, 8419, 8421, 8423, 8425, 8427, 8429, 8431, 8433, 8435, 8437, 8439, 8441, 8443, 8445, 8447, 8449, 8451, 8453, 8455, 8457, 8459, 8461, 8463, 8465, 8467, 8469, 8471, 8473, 8475, 8477, 8479, 8797, 8799, 8801, 8803, 8805, 8807, 8809, 8811, 8813, 8815, 8817, 8819, 8821, 8823, 8825, 8827, 8829, 8831, 8833, 8835, 8837, 8839, 8841, 8843, 8845, 8847, 8849, 8851, 8853, 8855, 8857, 8859, 8861, 8863, 8865, 8867, 8869, 8871, 8873, 8875, 8877, 8879, 8881, 8883, 8885, 8887, 8889, 8891, 8893, 8895, 8897, 8899, 8901, 8903, 8905, 8907, 8909, 8911, 8913, 8915, 8917, 8919, 8921, 8923, 8925, 8927, 8929, 8931, 8933, 8935, 8937, 8939, 8941, 8943, 8945, 8947, 8949, 8951, 8953, 8955, 8957, 8959, 8961, 8963, 8965, 8967, 8969, 8971, 8973, 8975, 8977, 8979, 8981, 8983, 8985, 8987, 8989, 8991, 8993, 8995, 8997, 8999, 9001, 9003, 9005, 9007, 9009, 9011, 9013, 9015, 9017, 9019, 9021, 9023, 9025, 9027, 9029, 9031, 9033, 9035, 9037, 9039, 9041, 9043, 9045, 9047, 9049, 9051, 9053, 9055, 9057, 9059, 9061, 9063, 9065, 9067, 9069, 9071, 9073, 9075, 9077, 9079, 9081, 9083, 9085, 9087, 9089, 9091, 9093, 9095, 9097, 9099, 9101, 9103, and/or 9105.

In some embodiments, the polynucleotides are capable of hybridizing under highly stringent conditions to a reference polynucleotide sequence selected from any polynucleotide sequence provided herein, or a complement thereof, or a polynucleotide sequence encoding any of the variant enzyme polypeptides provided herein. In some embodiments, the polynucleotide capable of hybridizing under highly stringent conditions encodes a enzyme polypeptide comprising an amino acid sequence that has one or more residue differences as compared to a reference sequence.

In some embodiments, an isolated polynucleotide encoding any of the engineered enzyme polypeptides herein is manipulated in a variety of ways to facilitate expression of the enzyme polypeptide. In some embodiments, the polynucleotides encoding the enzyme polypeptides comprise expression vectors where one or more control sequences is present to regulate the expression of the enzyme polynucleotides and/or polypeptides. Manipulation of the isolated polynucleotide prior to its insertion into a vector may be desirable or necessary depending on the expression vector utilized.

Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the enzyme polypeptide. Any suitable terminator which is functional in the host cell of choice finds use in the present invention. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3- phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the enzyme polypeptide. Any suitable leader sequence that is functional in the host cell of choice find use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (See e.g., Guo and Sherman, Mol. Cell. Bio., 15:5983-5990 [1995]).

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for *Bacillus* NCB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered enzyme polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the enzyme polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the enzyme polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated.

Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. orzyae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. orzyae*), sC (sulfate adenyltransferase), and trpC (anthranilate synthase), as well as equivalents thereof. In another aspect, the present invention provides a host cell comprising at least one polynucleotide encoding at least one engineered enzyme polypeptide of the present invention, the polynucleotide(s) being operatively linked to one or more control sequences for expression of the engineered enzyme enzyme(s) in the host cell. Host cells suitable for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (AfhuA) and BL21).

Accordingly, in another aspect, the present invention provides methods of producing the engineered enzyme polypeptides, where the methods comprise culturing a host cell capable of expressing a polynucleotide encoding the engineered enzyme polypeptide under conditions suitable for expression of the polypeptide. In some embodiments, the methods further comprise the steps of isolating and/or purifying the enzyme polypeptides, as described herein.

Appropriate culture media and growth conditions for host cells are well known in the art. It is contemplated that any suitable method for introducing polynucleotides for expression of the enzyme polypeptides into cells will find use in the present invention. Suitable techniques include, but are not limited to electroporation, biolistic particle bombardment, liposome mediated transfection, calcium chloride transfection, and protoplast fusion.

Various features and embodiments of the present invention are illustrated in the following representative examples, which are intended to be illustrative, and not limiting.

EXPERIMENTAL

The following Examples, including experiments and results achieved, are provided for illustrative purposes only and are not to be construed as limiting the present invention. Indeed, there are various suitable sources for many of the reagents and equipment described below. It is not intended that the present invention be limited to any particular source for any reagent or equipment item.

In the experimental disclosure below, the following abbreviations apply: M (molar); mM (millimolar); uM and M (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); CV (coefficient of variability); CAM and cam (chloramphenicol); PMBS (polymyxin B sulfate); IPTG (isopropyl β-D-1-thiogalactopyranoside); LB (Luria broth); TB (terrific broth); SFP (shake flask powder); CDS (coding sequence); DNA (deoxyribonucleic acid); RNA (ribonucleic acid); nt (nucleotide; polynucleotide); aa (amino acid; polypeptide); *E. coli* W3110 (commonly used laboratory *E. coli* strain, available from the Coli Genetic Stock Center [CGSC], New Haven, CT); AcSus (*Acidithiobacillus caldus* sucrose synthase); SUS, SuS, and SuSy (sucrose synthase, also known as sucrose synthetase); NDP (nucleoside diphosphate); adenosine diphosphate (ADP); cytidine diphosphate (CDP); guanosine diphosphate (GDP); thymidine diphosphate (TDP); uridine diphosphate (UDP); inosine diphosphate (IDP); GT (glycosyltransferase); UGT (UDP-glucose-dependent glycosyltransferase); NGT (NDP-nucleoside diphosphate-dependent glycosyltransferase); AGT (ADP-glucose-dependent glycosyltransferase); CGT (CDP-glucose-dependent glycosyltransferase); GGT (GDP-glucose-dependent glycosyltransferase); TGT (TDP-glucose-dependent glycosyltransferase); IGT (IDP-glucose-dependent glycosyltransferase); UGT (UDP-glucose-dependent glycosyltransferase); reb (rebaudioside); rebA (rebaudioside A); rebD (rebaudioside D); rebI (rebaudioside I); rebM (rebaudioside M); "Reb A 60" is a ~1:2 mixture of stevioside and rebaudioside A respectively; HTP (high throughput); HPLC (high pressure liquid chromatography); HPLC-UV (HPLC-Ultraviolet Visible Detector); 1H NMR (proton nuclear magnetic resonance spectroscopy); HSQC NMR (heteronuclear single quantum coherence spectroscopy NMR); COSY NMR (homonuclear correlation spectroscopy NMR); Acorn (Acorn NMR, Livermore, CA); FIOPC (fold improvements over positive control); Sigma and Sigma-Aldrich (Sigma-Aldrich, St. Louis, MO; Difco (Difco Laboratories, BD Diagnostic Systems, Detroit, MI); Microfluidics (Microfluidics, Westwood, MA); ChromaDex (ChromaDex, Inc., Irvine, CA); Life Technologies (Life Technologies, a part of Fisher Scientific, Waltham, MA); Amresco (Amresco, LLC, Solon, OH); Carbosynth (Carbosynth, Ltd., Berkshire, UK); Varian (Varian Medical Systems, Palo Alto, CA); Agilent (Agilent Technologies, Inc., Santa Clara, CA); and Thermotron (Thermotron, Inc., Holland, MI).

Example 1

Synthesis, Optimization, and Assaying of UGT Enzymes with Glucosylation Activity In this Example, methods used in the synthesis, optimization and assaying of UGT enzymes with glucosylation activity are described.

Gene Synthesis and Optimization:

The polynucleotide sequence (SEQ ID NO: 1) encoding the wild-type *Stevia rebaudiana* polypeptide (SEQ ID NO: 2) reported to glucosylate steviolbioside to rebaudioside B and glucosylate stevioside to rebaudioside A (See e.g., Richman et al., Plant J., 41:56-67 [2005]), was codon-optimized and synthesized as the gene of SEQ ID NO: 3. This synthetic gene (SEQ ID NO: 3) was cloned into a pCK110900 vector system (See e.g., US Pat. Appln. Pubn. No. 2006/0195947, which is hereby incorporated by reference herein) and subsequently expressed in *E. coli* W3110 (AfhuA). The *E. coli* strain W3110 expressed the UGT enzymes under the control of the lac promoter.

Production of Shake Flask Powders (SFP):

A shake-flask procedure was used to generate the glycosyltransferase polypeptide shake flask powders (SFP) for characterization assays used in the biocatalytic processes described herein. Shake flask powder (SFP) preparation of enzymes provides a more purified preparation (e.g., up to >30% of total protein) of the enzyme as compared to the cell lysate used in HTP assays and also allows for the use of more concentrated enzyme solutions. A single colony of *E. coli* containing a plasmid encoding an engineered polypeptide of interest was inoculated into 5 mL Luria Bertani broth containing 30 μg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7.0, 1 mM MgS04) containing 30 μg/ml CAM, in a 1 L flask to an optical density of 600 nm (OD600) of 0.2 and allowed to grow at 30° C.

Expression of the glycosyltransferase gene was induced by addition of IPTG to a final concentration of 1 mM when the OD600 of the culture was 0.6 to 0.8. Incubation was then continued overnight (at least 16 hours). Cells were harvested by centrifugation (5000 rpm, 15 min, 4° C.) and the supernatant discarded. The cell pellet was resuspended in two volumes of 25 mM triethanolamine buffer, pH 7.5, and passed through a MICROFLUIDIZER® high pressure homogenizer (Microfluidics), with standard *E. coli* lysis settings and maintained at 4° C. Cell debris was removed by centrifugation (10,000 rpm, 45 minutes, 4° C.). The cleared lysate supernatant was collected and frozen at −80° C. and then either His-affinity purified and dialyzed to produce purified protein or lyophilized to produce a dry shake-flask powder of crude protein.

Assay of SFP for Stevioside Glucosylation:

SFP was reconstituted to provide 20 g/L powder. Then, 50 μL of these stocks were diluted in 200 μL total reaction volume of 50 mM Tris-HCl buffer, pH 7.5, with 3 mM MgSO4 and 1 mM stevioside (ChromaDex, >94% purity), with 2 mM uridine diphosphoglucose. The reaction was performed at 30° C. in a Thermotron® titre-plate shaker with 300 RPM shaking for 16-18h.

HPLC-MS/MS Analysis:

The reaction described above was quenched with 0.5 volume/volume acetonitrile with 0.2% formic acid and precipitated by centrifugation. Glycosylated stevioside products were detected in the supernatant by LC-MS/MS with the following instrument and parameters:

TABLE 1.1

HPLC-MS/MS Analysis of Steviol Glycosides

| | |
|---|---|
| Instrument Column | Agilent HPLC 1200 series, Sciex 4000 QTrap Poroshell 120 EC C18 50 × 3.0 mm, 2.7 μm with Poroshell 120 EC C18 5 × 3.0, 2.7 μm guard column (Agilent Technologies) |
| Mobile phase | Gradient (A: 0.1% formic acid in water, B: 0.1% formic acid in methanol) |

| Time (m) | % B |
|---|---|
| 0 | 60 |
| 0.50 | 60 |
| 1.00 | 70 |
| 4.33 | 70 |
| 5.00 | 95 |
| 5.33 | 9 |
| 5.34 | 60 |
| 6.00 | 60 |

| | |
|---|---|
| Flow rate | 0.8 mL/m |
| Run time | 6 m |
| Peak retention times | Rebaudioside A: 2.35 m |
| Column temperature | 40° C. |
| Injection volume | 10 μL |
| MS detection | MRM 990/828 (for steviol tetraglycosides, e.g., rebaudioside A), 1152/828 (for steviol pentaglycosides, e.g., rebaudioside D), 1314/828 (steviol hexaglycosides, e.g., rebaudioside M), 828/666 (for steviol triglycosides, e.g., stevioside), 666/504 (steviol diglycosides, e.g., rubusoside) |
| MS conditions | MODE: MRM; CUR: 30; IS: 4750; CAD: high; TEM: 550° C.; GS1: 50; G52: 50; DP: 150; EP: 10; CXP: 14; DT: 50 ms for each transition. For the first three transitions CE: 85; for the last two transitions CE: 60. |

Activity was detected for SEQ ID NO:4. High conversion (i.e., >95%), of stevioside to rebaudioside A was observed in the LC-MS/MS analysis of the assay samples described above.

Example 2

GT Variants of SEQ ID NO: 4

In this Example, experiments for evolution and screening of GT polypeptides derived from SEQ ID NO: 4 for improved glucosylation of steviol glycosides using ADP-glucose are described. Directed evolution of the GT encoded by SEQ ID NO: 3 (i.e., SEQ ID NO:4) was carried out by constructing libraries of variant genes in which positions associated with certain structural features of the enzyme were subjected to mutagenesis. These libraries were then plated, grown, and screened using the high-throughput (HTP) assay described below to provide a first round ("Round 1") of 12 engineered GT variant polypeptides with glucosyltransferase activity toward ADP-glucose and steviol glycosides.

HTP Growth, Expression, and Lysate Preparation

Cells were picked into 96-well plates and grown overnight in LB media containing 1% glucose and 30 μg/mL CAM, 30° C., 200 rpm, 85% humidity. Then, 20 μL of overnight growth were transferred to a deep-well plate containing 380 μL TB growth media containing 30 μg/mL CAM, induced with 1 mM IPTG, and incubated for 18 h at 30° C., 200 rpm, 85% humidity. Cell cultures were centrifuged at 4000 rpm, 4° C. for 10 m, and the media discarded. Cell pellets thus obtained were frozen at −80° C., and lysed in 250 µL lysis buffer (0.5 g/L lysozyme and 0.5 g/L PMBS in 20 mM Tris-HCl buffer, pH 7.5) with low-speed shaking for 2 h on titre-plate shaker at room temperature. The plates were then centrifuged at 4000 rpm and 4° C. for 20 min and the cleared lysate supernatants were used in the HTP assay reactions described below.

HTP Assay for Glucose Transfer from ADP-Glucose to Stevioside:

Assays were performed on 96-well plates of cleared *E. coli* culture lysates expressing SEQ ID NO: 3 variants with lysate loading of 50 µL lysate in 200 µL reactions and with substrate loading of 1 mM stevioside (ChromaDex, >94% purity), from a 20 mM stock solution in 50% ethanol and co-substrate loading of 0.5 mM ADP-glucose (Sigma, >93% purity). The following reaction conditions were used: 50 mM Tris-HCl buffer, pH 7.5, 3 mM MgCl$_2$, 30° C. in a Thermotron® titre-plate shaker with 300 RPM shaking for 18 h. The reactions were quenched with 100 µL/well acetonitrile with 0.2% formic acid, centrifuged 10 m at 4° C., and the supernatants were analyzed by HPLC-MS/MS as described in Example 1, Table 1.1.

Formation of rebaudioside A from stevioside in the presence of wild-type UGT76G1 (SEQ ID NO:4) with ADP-glucose was indistinguishable from a no enzyme control. In contrast to the wild-type enzyme of SEQ ID NO:4, glycosyltransferase variant polypeptides were identified that produced rebaudioside A from stevioside with ADP-glucose. The engineered polypeptides are listed in Table 2.1. Although the parent and variant constructs contain an N-terminal histidine tag for affinity purification, the mutations were numbered relative to the untagged reference sequence for clarity. Shake-flask scale cultures were grown for protein purification as described in Example 1. Variants with the following amino acid mutations shown in Table 2.1, relative to SEQ ID NO:4 were analyzed.

TABLE 2.1

Variants and RebA Levels

| SEQ ID NO: (nt/aa) | Amino Acid Differences (Relative to SEQ ID NO: 4) | Increased RebA[a] |
|---|---|---|
| 5/6 | V309R | ++ |
| 7/8 | R10-/V309R | ++ |
| 9/10 | S361G | ++ |
| 11/12 | V309S | ++ |
| 13/14 | L307V | + |
| 15/16 | S283T | + |
| 17/18 | V309L | + |
| 19/20 | Y278L/T284I/R311G/V339A/N360G | + |
| 21/22 | V309N | + |
| 23/24 | R262L | + |
| 25/26 | V339A/S361G | + |
| 27/28 | V344I/S361G | + |
| 29/30 | R262K | + |

[a]Levels of increased production were determined relative to the reference polypeptide of SEQ ID NO: 4, and defined as follows:
"+" = production at least that of the reference polypeptide, but less than 1.3-fold; and
"++" = at least 1.3-fold, but less than 1.6-fold increased production, as compared to the reference polypeptide.

Purified Protein Characterization Assay and Analysis for Glucosyl Transfer from ADP-Glucose to Stevioside or Rebaudioside D:

First, 250 mL shake flask cultures were grown, induced, lysed, histidine-affinity purified, dialyzed, and diluted 1:1 with glycerol as described in Example 1, to produce purified protein. Then, 50 µL of these proteins were diluted in 200 µL total reaction volume of 50 mM Tris-HCl buffer, pH 7.5, 3 mM MgCl$_2$, with 1 mM stevioside (ChromaDex, >94% purity) or rebaudioside D (Sigma, >93% purity) and 0.5 mM ADP-glucose. The reaction was performed at 30° C. in a Thermotron® titre-plate shaker with 300 RPM shaking for 16 h. The reaction described above was quenched with 0.5 volume/volume acetonitrile with 0.2% formic acid and precipitated by centrifugation. Glycosylated products were detected in the supernatant by LC-MS/MS following 1:10 dilution in water with the instrument and parameters described in Example 1, Table 1.1.

TABLE 2.2

Purified Round 1 Variants and RebA and RebM Levels

| SEQ ID NO: (nt/aa) | Amino Acid Differences (Relative to SEQ ID NO: 4) | Increased RebA[a] | Increased RebM[a] |
|---|---|---|---|
| 7/8 | R10-/V309R | +++ | + |
| 9/10 | S361G | ++ | − |
| 11/12 | V309S | ++ | + |
| 13/14 | L307V | ++ | − |
| 15/16 | S283T | +++ | − |
| 29/30 | R262K | − | − |

[a]Levels of increased production were determined relative to the reference polypeptide of SEQ ID NO: 4, and defined as follows:
"−" = production less than 1.5-fold;
"+" = production at least 1.5- fold, but less than 2.5-fold;
"++" = at least 2.5-fold, but less than 3.5-fold; and
"+++" = at least 3.5-fold increased production, as compared to the reference polypeptide.

Variants with mutations R10- and V309R, S361G, V309S, L307V, and S283T (SEQ ID NOS: 8, 10, 12, 14, and 16) produced rebaudioside A from stevioside, at levels above the above negative control and SEQ ID NO: 2 levels with ADP-glucose. The variant with mutations R10- and V309R (SEQ ID NO: 8) and the variant with mutation V309S (SEQ ID NO: 12) produced rebaudioside M from rebaudioside D above negative control and SEQ ID NO: 2 levels with ADP-glucose. Thus, these engineered ADP-glycosyltransferase enzymes provide new biocatalytic reagents for use in new methods for the β-glucosylation of stevioside to rebaudioside A, and rebaudioside D to rebaudioside M. The variant with mutations R10- and V309R (SEQ ID NO: 8) had the highest activity on both stevioside and rebaudioside D with ADP-glucose as a co-substrate. Thus, the encoding polynucleotide (SEQ ID NO: 7) was selected for further directed evolution.

Example 3

ADP-Glycosyltransferase Variants of SEQ ID NO: 8

In this Example, experiments for evolution and screening of GT polypeptides derived from SEQ ID NO: 8, for improved glucosylation of steviol glycosides using ADP-glucose are described. Directed evolution of the GT encoded by SEQ ID NO: 7 (i.e., SEQ ID NO:8) was carried out by constructing libraries of variant genes in which mutations associated with improved activity in Round 1 were recombined. These libraries were then plated, grown, and screened using the high-throughput (HTP) assay described in Example 2 to provide a second round ("Round 2") of 20 engineered GT variant polypeptides with glucosyltransferase activity toward ADP-glucose and steviol glycosides. The engineered polypeptides are listed in Table 3.1. Although the parent and variant constructs contain an N-terminal histidine tag for affinity purification, the mutations were numbered relative to the untagged reference sequence for clarity. Shake-flask scale cultures were grown for protein purification as described in Example 1 for variants with the amino acid mutations shown in Table 3.1, relative to SEQ ID NO:8, as indicated below, were analyzed.

TABLE 3.1

Variants and RebA Levels

| SEQ ID NO: (nt/aa) | Amino Acid Differences (Relative to SEQ ID NO: 8) | Increased RebA[a] |
|---|---|---|
| 31/32 | T283Q/T318E/W337S/S360G | +++ |
| 33/34 | E112S/T172S/T283Q/T318E | ++ |
| 35/36 | T283Q | ++ |
| 37/38 | T283Q/S360G | ++ |
| 39/40 | T283Q/L306V/R308S/S360G | + |
| 41/42 | S282T/T283Q/Q431E | + |
| 43/44 | N137K/T283Q | + |
| 45/46 | T318E | + |
| 47/48 | E112S/R261S/T318E | + |
| 49/50 | N137K/T283Q/Q431E | + |
| 51/52 | S282T/T283Q | + |
| 53/54 | L163K/T318E | + |
| 55/56 | T283Q/L306V/W337S/A426V | + |
| 57/58 | R261S/T283Q/W337F | + |
| 59/60 | E112S/S282T/T283Q/Q431E | + |
| 61/62 | R261S/W337S | + |
| 63/64 | Q431E | + |
| 65/66 | S360G | + |
| 67/68 | Q269T/T318E | + |
| 69/70 | R261S/T283Q/L306V/W337F | + |

[a]Levels of increased production were determined relative to the reference polypeptide of SEQ ID NO: 7, and defined as follows:
"+" = production at least that of the reference polypeptide, but less than 1.5-fold;
"++" = at least 1.5-fold, but less than 2-fold; and
"+++" = at least 2-fold increased production, as compared to the reference polypeptide.

Purified Protein Characterization Assay and Analysis for Glucosyl Transfer from ADP-Glucose to Stevioside or Rebaudioside D Proteins were purified, assayed, and analyzed as described in Example 2.

TABLE 3.2

Purified Round 2 Variants and RebA and RebM Levels

| SEQ ID NO: (nt/aa) | Amino Acid Differences (Relative to SEQ ID NO: 8) | Increased RebA[a] | Increased RebM[a] |
|---|---|---|---|
| 31/32 | T283Q/T318E/W337S/S360G | +++ | +++ |
| 33/34 | E112S/T172S/T283Q/T318E | + | ++ |
| 35/36 | T283Q | + | + |
| 37/38 | T283Q/S360G | + | ++ |

[a]Levels of increased production were determined relative to the reference polypeptide of SEQ ID NO: 7, and defined as follows:
"+" = production at least that of the reference polypeptide, but less than 2-fold;
"++" = at least 2-fold, but less than 3-fold; and
"+++" = at least 3-fold increased production, as compared to the reference polypeptide.

All variants in Table 3.2 (SEQ ID NOS: 32, 34, 36, and 38) produced rebaudioside A from stevioside and rebaudioside M from rebaudioside D with ADP-glucose, at greater quantities than SEQ ID NO: 8. The variant with mutations T283Q, T318E, W337S, and S360G (SEQ ID NO: 32) had the highest activity on both stevioside and rebaudioside D with ADP-glucose as a co-substrate. Thus, the encoding polynucleotide (SEQ ID NO: 31) was selected for further directed evolution.

Purified Protein Characterization Assay and Analysis for Glucosyl Transfer from NDP-Glucose to Stevioside To profile the nucleotide diphosphate specificity of SEQ ID NO: 4 relative to SEQ ID NO: 32, the following experiment was performed. First, 50 μL purified protein was diluted in 200 μL total reaction volume of 50 mM Tris-HCl buffer, pH 7.5, 3 mM MgCl$_2$, with 1 mM stevioside (ChromaDex, >94% purity) and 0.5 mM ADP-glucose, UDP-glucose, or TDP-glucose. The reaction was performed at 30° C. in a Thermotron® titre-plate shaker with 300 RPM shaking for 16 h. The reaction described above was quenched with 0.5 volume/volume acetonitrile with 0.2% formic acid and precipitated by centrifugation. Glycosylated products were detected in the supernatant by LC-MS/MS following 1:10 dilution in water with the instrument and parameters described in Example 1, Table 1.1. SEQ ID NO: 32 produced 13-fold more rebaudioside A with ADP-glucose than did SEQ ID NO: 4, 90% as much with UDP-glucose, and 22% as much with TDP-glucose. The glycosyltransferase encoded by SEQ ID NO: 31 (i.e., SEQ ID NO:32) has substantially modified NDP-glucose specificity, as compared to the glycosyltransferase encoded by SEQ ID NO: 3 (i.e., SEQ ID NO:4).

Determination of Specific Activity of GT Encoded by SEQ ID NO: 31 on Rebaudioside D and NDP-Glucose To profile the nucleotide diphosphate specificity of SEQ ID NO: 32, the following experiment was performed. First, 5 μL purified protein was diluted in 100 μL total reaction volume of 50 mM Tris-HCl buffer, pH 7.5, 3 mM MgCl$_2$, with 1 mM rebaudioside D (ChromaDex, >93% purity) and 2 mM ADP-glucose, UDP-glucose, TDP-glucose, or GDP-glucose. The reaction was performed at 30° C. in a Thermotron® titre-plate shaker with 300 RPM shaking for 1-18 h. The reaction described above was quenched with 0.5 volume/volume acetonitrile with 0.2% formic acid and precipitated by centrifugation. Glycosylated products were detected in the supernatant by LC-MS/MS, following 1:10 dilution in water with the instrument and parameters described in Example 1, Table 1.1. The glycosyltransferase encoded by SEQ ID NO: 31 (i.e., SEQ ID NO:32), produced 50% as much rebaudioside M with GDP-glucose relative to ADP-glucose, 70% as much with UDP-glucose, and an amount below the detection limit with TDP-glucose. The specific activity (μmol RebM formed per mg purified protein per min) of GT SEQ ID NO: 32 with rebaudioside D and ADP-glucose was 1.4-fold higher than the specific activity with UDP-glucose. Therefore, the glycosyltransferase encoded by SEQ ID NO: 31 (i.e., SEQ ID NO:32) is a new adenine diphosphoglucose-dependent glycosyltransferase, or "AGT."

Example 4

Transformation of Stevioside to Rebaudioside A with Engineered AGT SEQ ID NO: 32 and In Situ Formation of ADP-Glucose In this Example, experiments to assess the in situ formation of ADP-glucose for glucosylation of steviol glycosides (See, FIG. 1) are described.

Gene Synthesis and Optimization

The polynucleotide sequences encoding the wild-type *Acidithiobacillus caldus* sucrose synthase and *Thermosynechococcus elongatus* sucrose synthase polypeptides (SEQ ID NOS: 72 and 74, respectively) reported to preferentially utilize ADP-glucose to donate a glucose to fructose to form sucrose in a reversible conversion (See e.g., Diricks et al., Appl. Microbiol. Biotechnol., 99:8465-74 [2015] and Figueroa et al., FEBS Lett., 587: 165-9 [2013]), were codon-optimized and synthesized as the gene of SEQ ID NOS: 71 and 73. These synthetic genes (SEQ ID NOS: 71 and 73) were individually cloned into a pCK110900 vector system (See e.g., US Pat. Appln. Pubn. No. 2006/0195947, which is hereby incorporated by reference herein), and subsequently expressed in *E. coli* W3110 (ΔfhuA). The *E.* coli strain W3110 expressed the enzymes under the control of the lac promoter. The strains were grown at shake-flask scale and lysed for His-affinity protein purification, which was performed as described in Example 1.

Coupled Assay with Purified AGT and Sucrose Synthase

To examine the potential for NDP recycling by coupling a sucrose synthase (SuS) with the AGT encoded by SEQ ID NO: 31 (i.e., SEQ ID NO:32), the following experiment was performed. First, 20 µL purified sucrose synthase polypeptide (SEQ ID NO: 72 or 74) and 30 µL purified AGT polypeptide (SEQ ID NO: 32) were diluted in 200 µL total reaction volume of 50 mM Tris-HCl buffer, pH 7.5, 5 mM MgCl$_2$, with 1 mM stevioside (ChromaDex, >94% purity), 200 mM sucrose, and 5 mM adenosine diphosphate (ADP), cytidine diphosphate (CDP), guanosine diphosphate (GDP), thymidine diphosphate (TDP), or uridine diphosphate (UDP) (Sigma, all 5 >93% purity). The reaction was performed at 30° C. in a Thermotron® titre-plate shaker with 300 RPM shaking for 16 h. The reaction described above was quenched with 0.5 volume/volume acetonitrile with 0.2% formic acid and precipitated by centrifugation.

Glycosylated products were detected in the supernatant by LC-MS/MS following 1:10 dilution in water with the instrument and parameters described in Example 1, Table 1.1.

For SEQ ID NO: 32 and SuS (SEQ ID NO: 74), comparable amounts of rebaudioside A were formed with ADP, UDP, and GDP, and almost no rebaudioside A was formed with CDP and TDP. For SEQ ID NO: 32 and SuS (SEQ ID NO: 72), the level of rebaudioside A formed with ADP was comparable to that formed with SuS (SEQ ID NO: 74) with ADP. The amount of rebaudioside A formed with UDP was less than 20% of that formed with ADP, and almost no rebaudioside A was formed with GT (SEQ ID NO: 32) and SuS (SEQ ID NO: 72) and CDP, GDP, or TDP. These results demonstrate that both SEQ ID NOS: 72 and 74 are capable of generating ADP-glucose in situ from sucrose and find use with AGT (SEQ ID NO: 32) for glucosylation of steviol glycosides with sucrose and ADP as co-substrates instead of the more expensive substrate ADP-glucose. In addition, SEQ ID NO: 72 can also be used with GDP and UDP. In some embodiments involving ADP-selective coupling systems, SEQ ID NO: 74 finds use.

Example 5

ADP-Glycosyltransferase Circular Permuted Variants of SEQ ID NO: 32

In this Example, experiments for design, construction, and evaluation of GT polypeptides derived from SEQ ID NO: 32 for glucosylation of steviol glycosides using ADP-glucose are described. Directed evolution of the GT encoded by SEQ ID NO: 31 was carried out by constructing libraries of variant genes in which the N- and C-termini were linked in the encoding sequence and positions associated with certain structural features of the enzyme were selected as the new N-terminus of the protein. This library of circular permuted variants was then plated, grown, and screened using the high-throughput (HTP) assay described below to provide a "Round 3.2" of 17 engineered GT circular permuted variant polypeptides with glucosyltransferase activity toward ADP-glucose and steviol glycosides. None of the variants had activity higher than the unpermuted SEQ ID NO: 32, but the 17 engineered polypeptides listed in Table 5.1 had activity higher than a no enzyme negative control.

HTP Assay for Glucose Transfer from ADP-Glucose to Stevioside

Assays were performed on 96-well plates of cleared E. coli culture lysates expressing SEQ ID NO: 31 variants with lysate loading of 25 µL lysate in 200 µL reactions and with substrate loading of 1 mM stevioside (ChromaDex, >94% purity), from a 20 mM stock solution in 50% ethanol and co-substrate loading of 0.5 mM ADP-glucose (Sigma, >93% purity). The following reaction conditions were used: 50 mM Tris-HCl buffer, pH 7.5, 3 mM MgCl$_2$, 30° C. in a Thermotron® titre-plate shaker with 300 RPM shaking for 4 h. The reactions were quenched with 100 µL/well acetonitrile with 0.2% formic acid, centrifuged 10 m at 4° C., and the supernatants were analyzed by HPLC-MS/MS as described in Example 1, Table 1.1.

The engineered polypeptides analyzed are listed in Table 5.1. Although the parent and variant constructs contain an N-terminal histidine tag for affinity purification, the amino acids were numbered relative to the untagged reference sequence for clarity. Shake-flask scale cultures were grown for protein purification as described in Example 1, for variants with the following first amino acids relative to SEQ ID NO 32: 71, 170, 259, and 401. These variants represented circular permutants from the most distinct regions of the protein.

TABLE 5.1

Circular Permuted Round 3.2 Variants

| SEQ ID NO: (nt/aa) | First Amino Acid Position (Relative to SEQ ID NO: 32) |
|---|---|
| 75/76 | 70 |
| 77/78 | 71 |
| 79/80 | 72 |
| 81/82 | 73 |
| 83/84 | 74 |
| 85/86 | 75 |
| 87/88 | 169 |
| 89/90 | 170 |
| 91/92 | 171 |
| 93/94 | 174 |
| 95/96 | 194 |
| 97/98 | 198 |
| 99/100 | 259 |
| 101/102 | 260 |
| 103/104 | 370 |
| 105/106 | 401 |
| 107/108 | 403 |

Determination of Specific Activity of Purified Circular Permuted GTs on Rebaudioside D and ADP-Glucose First, 10 µL purified protein was diluted in 100 µL total reaction volume of 50 mM Tris-HCl buffer, pH 7.5, 3 mM MgCl$_2$, with 1 mM rebaudioside D (ChromaDex, >93% purity) and 2 mM ADP-glucose. The reaction was performed at 30° C. in a Thermotron® titre-plate shaker with 300 RPM shaking for 1-4 h. The reaction described above was quenched with 0.5 volume/volume acetonitrile with 0.2% formic acid and precipitated by centrifugation.

Glycosylated products were detected in the supernatant by LC-MS/MS following 1:10 dilution in water with the instrument and parameters described in Example 1, Table 1.1. Of the four circular permutants, SEQ ID NO: 106 had the highest specific activity (µmol RebM formed per mg purified protein per min), followed by SEQ ID NO: 100, and SEQ ID NO: 90. SEQ ID NO: 78 had barely detectable activity. Thus, the glycosyltransferase encoded by SEQ ID NO: 105 (i.e., SEQ ID NO:106) was identified in these experiments as the best candidate circular permuted AGT for further directed evolution.

Example 6

ADP-Glycosyltransferase Variants of SEQ ID NO: 32

In this Example, experiments for evolution and screening of GT polypeptides derived from SEQ ID NO: 32 for improved glucosylation of steviol glycosides using ADP-glucose are described. Directed evolution of the GT encoded by SEQ ID NO:31 (i.e., SEQ ID NO:32) was carried out by constructing libraries of variant genes in which positions associated with certain structural features of the enzyme were subjected to mutagenesis. These libraries were then plated, grown, and screened using the high-throughput (HTP) assay described below to provide a third round ("Round 3.1") of 60 engineered GT variant polypeptides with glucosyltransferase activity toward ADP-glucose and steviol glycosides.

HTP Assay for Glucose Transfer from ADP-Glucose to Stevioside or Rebaudioside D

Assays were performed on 96-well plates of cleared E. coli culture lysates expressing SEQ ID NO: 32 variants with lysate loading of 25 μL lysate in 200 μL reactions and with substrate loading of 0.5 mM rebaudioside D or 1 mM stevioside (ChromaDex, >94% purity), from a 20 mM stock solution in 50% ethanol and co-substrate loading of 0.5 mM ADP-glucose (Sigma, >93% purity). The following reaction conditions were used: 50 mM Tris-HCl buffer, pH 7.5, 3 mM $MgCl_2$, 30° C. in a Thermotron® titre-plate shaker with 300 RPM shaking for 4h. The reactions were quenched with 100 μL/well acetonitrile with 0.2% formic acid, centrifuged 10 mat 4° C., and the supernatants were analyzed by HPLC-MS/MS as described in Example 1, Table 1.1.

The engineered polypeptides are listed in Table 6.1. Although the parent and variant constructs contain an N-terminal histidine tag for affinity purification, the mutations were numbered relative to the untagged reference sequence for clarity. Shake-flask scale cultures were grown for protein purification as described in Example 1 for variants with the amino acid mutations shown in Table 6.1, relative to SEQ ID NO: 32.

TABLE 6.1

Round 3.1 Variants and RebA/RebM Levels

| SEQ ID NO: (nt/aa) | Amino Acid Differences (Relative to SEQ ID NO: 32) | Increased RebA[a] | Increased RebM[a] |
|---|---|---|---|
| 109/110 | L84A | | + |
| 111/112 | L199G | | + |
| 113/114 | L84G | | +++ |
| 115/116 | M87A | | + |
| 117/118 | L199Q | | + |
| 119/120 | L199D | | + |
| 121/122 | I207L | | + |
| 123/124 | M87H | | ++ |
| 125/126 | I198M | | + |
| 127/128 | L199S | | +++ |
| 129/130 | H154Q | | + |
| 131/132 | S191R | | + |
| 133/134 | I198S | | + |
| 135/136 | L199K | | +++ |
| 137/138 | H154L | | +++ |
| 139/140 | L199A | | +++ |
| 141/142 | H154V | | ++ |
| 143/144 | I198V | | + |
| 145/146 | H154A | | + |
| 147/148 | Q22A | ++ | |
| 149/150 | Q22L | + | |
| 151/152 | Q22P | +++ | |
| 153/154 | S356G | +++ | |
| 155/156 | Q22H | + | |
| 157/158 | L306V | + | |
| 159/160 | T262G | + | |
| 161/162 | D169T | + | |
| 163/164 | G347D | + | |
| 165/166 | S179V | + | |
| 167/168 | Q159M | + | |
| 169/170 | I233R | + | |
| 171/172 | Y396R | ++ | |
| 173/174 | E6P | + | |
| 175/176 | R139P | ++ | |
| 177/178 | Y421V | + | |
| 179/180 | R261W | + | |
| 181/182 | L106S | ++ | |
| 183/184 | N137G | ++ | |
| 185/186 | A97S | ++ | |
| 187/188 | R74W | + | |
| 189/190 | A110S | + | |
| 191/192 | R261P | +++ | |
| 193/194 | Q159R | + | |
| 195/196 | N195G | + | |
| 197/198 | E417R | + | |
| 199/200 | L106T | + | |
| 201/202 | R427A | + | |
| 203/204 | F64P | + | |
| 205/206 | H259Q | + | |
| 207/208 | R261H | + | |
| 209/210 | E417P | + | |
| 211/212 | K4P | + | |
| 213/214 | V435Q | + | |
| 215/216 | L106G | + | |
| 217/218 | L106D | + | |
| 219/220 | R261A | + | |
| 221/222 | E417A | + | |
| 223/224 | E112P | + | |
| 225/226 | V435R | + | |
| 227/228 | E112A | + | |

[a]Levels of increased production were determined relative to the reference polypeptide of SEQ ID NO: 32, and defined as follows:
"–" = production less than the reference polypeptide;
"+" = production at least that of the reference polypeptide, but less than 2-fold;
"++" = at least 2-fold, but less than 3-fold; and
"+++" = at least 3-fold increased production, as compared to the reference polypeptide.

Purified Protein Characterization Assay and Analysis for Glucosyl Transfer from ADP-Glucose to Stevioside or Rebaudiosided D First, 1 μL purified protein was diluted in 100 μL total reaction volume of 50 mM Tris-HCl buffer, pH 7.5, 3 mM $MgCl_2$, with 1 mM stevioside (Chromadex, >94% purity) or rebaudioside D (ChromaDex, >93% purity) and mM ADP-glucose. The reaction was performed at 30° C. in a Thermotron® titre-plate shaker with 300 RPM shaking for 1-30 h. The reaction described above was quenched with 0.5 volume/volume acetonitrile with 0.2% formic acid and precipitated by centrifugation. Glycosylated products were detected in the supernatant by LC-MS/MS following 1:10 dilution in water with the instrument and parameters described in Example 1, Table 1.1. Specific activities described in Table 6.2 for stevioside and rebaudioside D were determined as μmol product formed per min per mg purified protein from the linear portion of the reaction progress curve.

TABLE 6.2

Round 3.1 Variant Specific Activity for Stevioside and RebD

| SEQ ID NO: (nt/aa) | Amino Acid Differences (Relative to SEQ ID NO: 32) | μmol RebA/ min-mg$^a$ | μmol RebM/ min-mg$^a$ |
|---|---|---|---|
| 113/114 | L84G | + | ++ |
| 123/124 | M87H | − | − |
| 127/128 | L199S | − | ++ |
| 151/152 | Q22P | + | +++ |
| 153/154 | S356G | + | +++ |
| 157/158 | L306V | − | ++ |

$^a$Levels of increased specific activity were determined relative to the reference polypeptide of SEQ ID NO: 32, and defined as follows:
"−" = activity less than 1.5-fold;
"+" = activity at least 1.5-fold, but less than 3-fold;
"++" = at least 3-fold, but less than 6-fold; and
"+++" = at least 6-fold increased activity, as compared to the reference polypeptide.

Directed evolution of the GT encoded by SEQ ID NO:31 (i.e., SEQ ID NO:32) was continued by constructing libraries of variant genes in which mutations associated with improved activity above were recombined. These libraries were then plated, grown, and screened using the high-throughput (HTP) assay described above with rebaudioside D to provide Round 3.3 with 59 engineered GT variant polypeptides with glucosyltransferase activity toward ADP-glucose and steviol glycosides. The engineered polypeptides are listed in Table 6.3. Shake-flask scale cultures were grown for protein purification as described in Example 1 for variants with the amino acid mutations as shown in Table 6.3, relative to SEQ ID NO: 32.

TABLE 6.3

Round 3.3 Variants and RebM Levels

| SEQ ID NO: (nt/aa) | Amino Acid Differences (Relative to SEQ ID NO: 32) | Increased RebM$^a$ |
|---|---|---|
| 229/230 | Q22P/L84G/H154L/I198S/L199A/S356G | ++++ |
| 231/232 | Q22P/L84G/H154L/L199A/S356G | ++++ |
| 233/234 | Q22P/L84G/H154L/I198S/L199S/S356G | ++++ |
| 235/236 | Q22P/L84V/H154V/I198S/L199S/L306V/S356G | ++++ |
| 237/238 | Q22P/L84G/H154V/I198S/L199A/L306V/S356G | ++++ |
| 239/240 | Q22P/L84G/H154L/I198S/L199K/S356G | ++++ |
| 241/242 | Q22P/L84G/H154L/L199S/S356G | ++++ |
| 243/244 | Q22P/L84G/M87H/H154L/I198S/L199S/L306V/S356G | ++++ |
| 245/246 | Q22P/L84G/L199A/L306V/S356G | ++++ |
| 247/248 | Q22P/L84G/M87H/H154L/I198S/L199A/S356G | ++++ |
| 249/250 | Q22P/L84G/H154V/I198S/L199K/L306V/S356G | ++++ |
| 251/252 | Q22P/L84G/M87H/H154L/L199K/L306V/S356G | ++++ |
| 253/254 | Q22P/L84G/H154V/L199S/S356G | ++++ |
| 255/256 | Q22P/M87H/H154L/L199A/L306V/S356G | +++ |
| 257/258 | Q22P/L84G/M87H/H154V/I198S/L199S/L306V/S356G | +++ |
| 259/260 | Q22P/L84G/I198S/L199K/L306V/S356G | +++ |
| 261/262 | Q22P/L84G/H154V/L199A/S356G | +++ |
| 263/264 | Q22P/H154L/I198S/L199A/I207L/L306V/S356G | +++ |
| 265/266 | Q22P/H154L/L199A/S356G | +++ |
| 267/268 | Q22P/H154L/I198S/L199A/S356G | +++ |
| 269/270 | Q22P/L84G/M87H/H154V/L199K/L306V/S356G | +++ |
| 271/272 | Q22P/M87H/H154V/I198S/L199S/I207L/L306V/S356G | +++ |
| 273/274 | Q22P/L84G/H154L/I207L/L306V/S356G | +++ |
| 275/276 | Q22P/L84G/H154L/L306V/S356G | +++ |
| 277/278 | Q22P/M87H/H154V/L199S/S356G | ++ |
| 279/280 | Q22P/M87H/L199A/S356G | ++ |
| 281/282 | Q22P/H154V/I198S/L199S/L306V/S356G | ++ |
| 283/284 | Q22P/L84G/M87H/L199A/L306V/S356G | ++ |
| 285/286 | Q22P/M87H/H154V/L199A/I207L/S356G | ++ |
| 287/288 | Q22P/L84G/I198S/S356G | ++ |
| 289/290 | Q22P/L84G/H154L/I198S/L199A/I207L/L306V | ++ |
| 291/292 | Q22P/M87H/H154L/I198S/L199K/S356G | ++ |
| 293/294 | Q22P/L84G/M87H/I198S/L199K/S356G | ++ |
| 295/296 | Q22P/H154V/L199A/S356G | ++ |
| 297/298 | Q22P/M87H/H154V/L199K/S356G | ++ |
| 299/300 | Q22P/H154V/L199K/I207L/L306V/S356G | ++ |
| 301/302 | Q22P/L84G/I207L/S356G | ++ |
| 303/304 | Q22P/M87H/H154V/L199S/L306V/S356G | ++ |
| 305/306 | Q22P/M87H/L199K/S356G | ++ |
| 307/308 | Q22P/M87H/I198S/L199K/L306V/S356G | ++ |
| 309/310 | Q22P/M87H/H154L/P322S/S356G | ++ |
| 311/312 | Q22P/M87H/I198S/L199K/S356G | + |
| 313/314 | Q22P/L84G/H154L/L199K/I207L | + |
| 315/316 | Q22P/M87H/I198S/L199S/I207L/S356G | + |
| 317/318 | Q22P/L84G/M87H/I198S/L199A/L306V/S356G | + |
| 319/320 | Q22P/L84G/M87H/I198S/L199S/S356G | + |
| 321/322 | Q22P/L84G/M87H/I198S/L199S/L306V/S356G | + |
| 323/324 | Q22P/L199A/S356G | + |
| 325/326 | Q22P/L84G/H154L/I198S/L199A/L306V | + |
| 327/328 | L84G/H154L/I198S/L199K | + |
| 329/330 | Q22P/L84G/M87H/L199S/S356G | + |
| 331/332 | Q22P/L84G/M87H/H154L/S356G | + |
| 333/334 | Q22P/I198S/L199K/I207L/G329C/S356G | + |
| 335/336 | Q22P/M87H/H154V/I198S/L199K/S356G | + |
| 337/338 | Q22P/I198S/L199A/S356G | + |
| 339/340 | Q22P/M87H/I198S/L199A/L306V/S356G | + |
| 341/342 | Q22P/I207L/S356G | + |
| 343/344 | Q22P/L84G/S356G | + |
| 345/346 | Q22P/L84G/H154V/I198S/L199K | + |
| 1289/1290b | Q22P/S356G | − |

$^a$Levels of increased production were determined relative to the reference polypeptide of SEQ ID NO: 32, and defined as follows:
"−" = production less than 100-fold; the reference polypeptide;
"+" = production at least 100-fold and less than 300-fold;
"++" = at least 300-fold, but less than 600-fold;
"+++" = at least 600-fold, but less than 900-fold; and
"++++" = greater than 900-fold increased production, as compared to the reference polypeptide.
$^b$Does not contain diversity specific to conversion of rebaudioside D to rebaudioside M; useful as an engineered biocatalyst to convert stevioside to rebaudioside A.

Purified Protein Characterization Assay and Analysis for Glucosyl Transfer from ADP-Glucose to Stevioside or Rebaudioside D First, 2 μL purified protein was diluted in 100 μL total reaction volume of 50 mM Tris-HCl buffer, pH 7.5, 3 mM $MgCl_2$, with 1 mM rebaudioside D (ChromaDex, >93% purity) and 2 mM ADP-glucose. The reaction was performed at 30° C. in a Thermotron® titre-plate shaker with 300 RPM shaking for 1-18 h. The reaction described above was quenched with 0.5 volume/volume acetonitrile with 0.2% formic acid and precipitated by centrifugation.

Glycosylated products were detected in the supernatant by LC-MS/MS following 1:50 dilution in water with the instrument and parameters described in Example 1, Table 1.1. Specific activities described in Table 6.4 for stevioside was determined as mol rebaudioside A product formed per min per mg purified protein and for rebaudioside D was determined as μmol rebaudioside M product formed per min per mg purified protein from the linear portion of the reaction progress curve. The enzymes listed in Table 6.4 catalyzed the conversion of RebD to RebM to >99% conversion and catalyzed the conversion of stevioside to a mixture of RebA and RebI with >85% conversion in less than 18 h with 0.8 g/L stevioside or 1.3 g/L rebD, 2 molar excess of ADP-glucose, and 35-77 mg/L purified protein.

TABLE 6.4

Round 3.3 Variants Specific Activity for Stevioside and RebD

| SEQ ID NO: (nt/aa) | Amino Acid Differences (Relative to SEQ ID NO: 32) | µmol RebA/ min-mg[a] | µmol RebM/ min-mg[a] |
|---|---|---|---|
| 229/230 | Q22P/L84G/H154L/I198S/L199A/S356G | + | ++ |
| 231/232 | Q22P/L84G/H154L/L199A/S356G | ++ | +++ |
| 233/234 | Q22P/L84G/H154L/I198S/L199S/S356G | ++ | ++ |
| 237/238 | Q22P/L84G/H154V/I198S/L199A/L306V/S356G | ++ | ++ |
| 243/244 | Q22P/L84G/M87H/H154L/I198S/L199S/L306V/S356G | + | + |
| 253/254 | Q22P/L84G/H154V/L199S/S356G | +++ | + |

[a]Levels of increased specific activity were determined relative to the reference polypeptide of SEQ ID NO: 32, and defined as follows:
"+" = activity at least that of the reference polypeptide, but less than 2-fold;
"++" = at least 2-fold, but less than 4-fold; and
"+++" = at least 4-fold increased activity as compared to the reference polypeptide.
[b]Levels of increased activity were determined relative to the reference polypeptide of SEQ ID NO: 32, and defined as follows:
"−" = activity less than 10-fold;
"+" = activity at least 10-fold, but less than 15-fold;
"++" = at least 15-fold, but less than 20-fold; and
"+++" = at least 20-fold increased activity, as compared to the reference polypeptide.

Example 7

Transformation of Rebaudioside D to Rebaudioside M with AGT (SEQ ID NO: 232)

A 250-mL shake-flask culture was grown for protein purification of the polypeptide SEQ ID NO: 232 as described in Example 1. Then, 2.4 mL of the 50% glycerol stock of was diluted in 60 mL total reaction volume in a 250-mL baffled flask with 50 mM Tris-HCl buffer, pH 7.5, 3 mM MgCl2, 2 mM ADP-glucose, and 1 mM rebaudioside D (ChromaDex, >93% purity). The reaction was performed at 30° C. in an Innova® shaking incubator with 250 RPM shaking for 2 h and quenched to pH<4 with 0.12 mL formic acid. The reaction was precipitated by centrifugation at 10,000 RPM for 10 m at 4° C. 6 g XAD-4 resin (Sigma) were added to the supernatant and incubated in the shake flask for 2 h. The resin was filtered and eluted with 16.3 mL 50:24:26 water:ACN:EtOH by incubating 4 h and re-filtering. A second elution was performed with 10 mL 50:50 water:EtOH, which filtered and combined with the first elution. The eluent was concentrated to about 6 mL by rotary evaporation, filtered through WHATMAN® UNIPREP® syringeless filters, and fractionated by HPLC using the instrument and parameters described in Table 7.1. From the C18 column, fractions were manually collected at retention times 5.8-6.2 m. Fractions were pooled, concentrated by rotary evaporation, and lyophilized. The sample was then resuspended in 1.5 mL ethanol and incubated on a stir plate at 80° C. for 2 h, concentrated by rotary evaporation, and dried 14 h under vacuum at 40° C. The samples were resuspended in pyridine-d5 and used for 1H, COSY, and HSQC NMR spectra acquisition performed by Acorn NMR.

TABLE 7.1

Semi-Preparative HPLC Fractionation of Steviol Glycosides

| | |
|---|---|
| Instrument | Agilent HPLC 1200 series |
| Column | Higgins C18 250 × 10 mm, 5 µm (Higgins Analytical) |
| Mobile phase | Isocratic 68:32 A:B A: 0.1% formic acid in water B: 0.1% formic acid in methanol |
| Flow rate | 2.5 mL/m |
| Run time | 10 m |
| Peak retention times | Rebaudioside M 6.00 m |
| Column temperature | 40° C. |
| Injection volume | 100 µL |
| UV detection | 210 nm (for steviol glycosides) 254 nm (for organic contaminants) |

Figure 2:
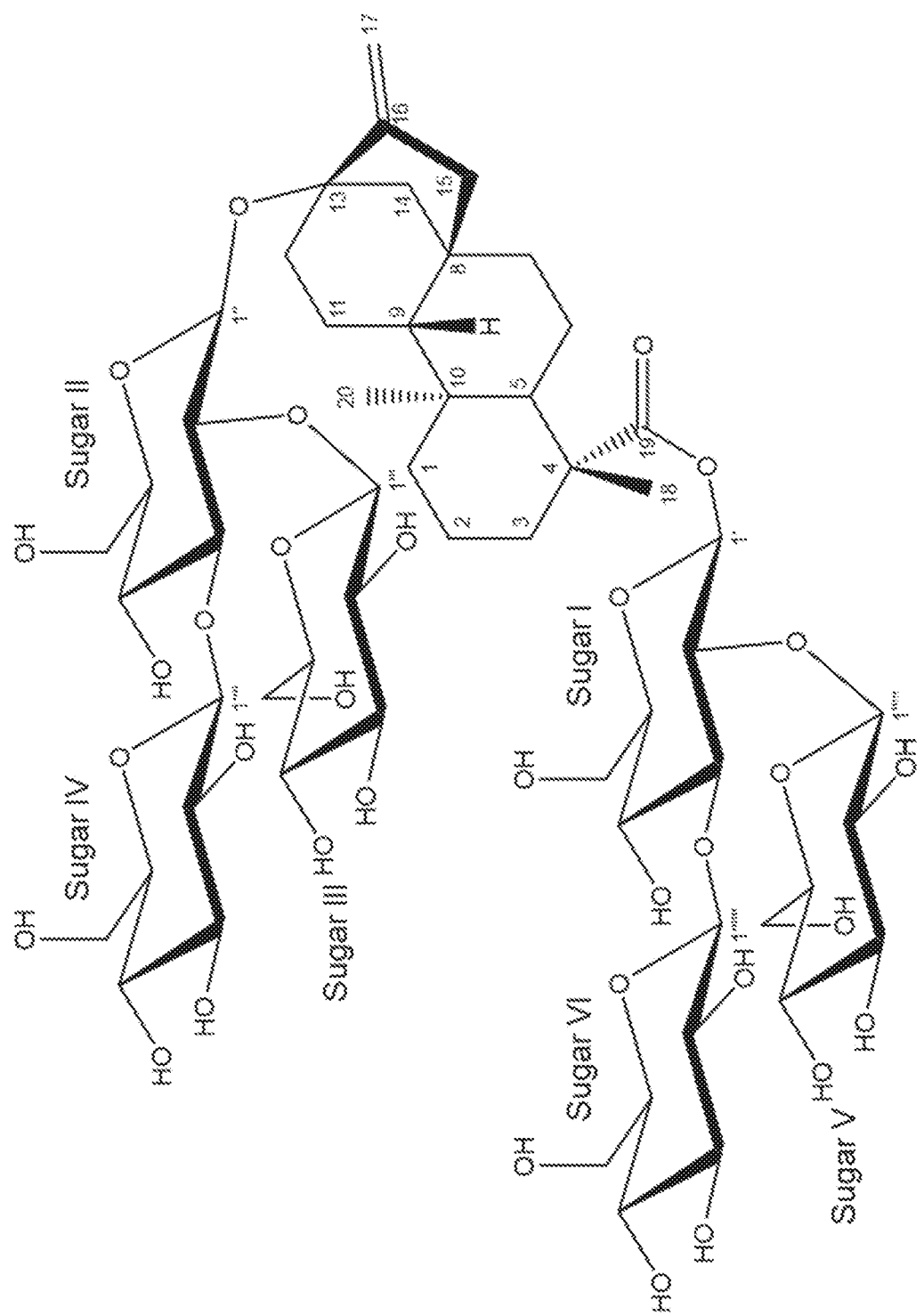
FIG. 2 provides the structure of rebaudioside M with the carbons numbered.

The isolated product was determined to be rebaudioside M based on identity of the spectra to that of an authentic rebaudioside M standard (Chromadex, purity 95.6% by HPLC). By $^1$H NMR, the exchangeable protons in the sample were broader than those in the standard and the sample contained a minor methyl contaminant. Otherwise, the spectra of the sample and standard were identical. Except for minor impurities, the COSY and HSQC spectra of the sample and standard were identical. The presence of six anomeric protons evident from the $^1$H and $^1$H-$^{13}$C HSQC spectra [$\delta_H$ 6.44, $\delta_H$ 5.85, $\delta_H$ 5.524, $\delta_H$ 5.518, $\delta_H$ 5.49, $\delta_H$ 5.34] confirmed the presence of six sugar units in the structure and were coincident with the standard, indicating β-anomeric conformation. The attachment of sugars at the C2' and C3' hydroxyl positions is supported by the relatively downfield chemical shift of H-2' ($\delta_H$ 4.54) and H-3' ($\delta_H$ 5.15) in sugar I, suggesting a 2,3-branched-D-glucotriosyl substituent at C-19 (See FIG. 2 for carbon numbering). Peak assignments are listed in Table 7.2 and were determined from $^1$H, COSY, and HSQC spectra and compared to literature (See e.g., Prakash et al., Nat. Prod. Comm., 11:1523-6 [2013]).

TABLE 7.2

NMR Spectra of Enzymatically Produced Rebaudioside M in C$_5$D$_5$N.

| Position | δ $^{13}$C, ppm | δ $^1$H, ppm | $^1$H Multiplicity (J, Hz) |
|---|---|---|---|
| 1 | 40.3 | 0.77 | t (12.1) |
| 1 | 40.3 | 1.79 | m |
| 2 | 19.6 | 1.37 | m |
| 2 | 19.6 | 2.27 | m |
| 3 | 38.4 | 1.04 | m |
| 3 | 38.4 | 2.32 | d (13.0) |
| 4 | | Null | |
| 5 | 57.3 | 1.08 | d (13.9) |
| 6 | 23.5 | 2.26 | m |
| 6 | 23.5 | 2.44 | q (12.6) |
| 7 | 42.6 | 1.45 | m |
| 7 | 42.6 | 1.83 | m |
| 8 | | Null | |
| 9 | 54.3 | 0.93 | d (8.49) |
| 10 | | Null | |
| 11 | 20.2 | 1.67 | m |
| 11 | 20.2 | 1.79 | m |
| 12 | 38.5 | 1.88 | m |
| 12 | 38.5 | 2.78 | m |
| 13 | | Null | |
| 14 | 43.3 | 2.05 | m |
| 14 | 43.3 | 2.77 | m |
| 15 | 46.5 | 1.9 | d (17) |
| 15 | 46.5 | 2.06 | m |
| 16 | | Null | |
| 17 | 104.9 | 4.92 | s |
| 17 | 104.9 | 5.72 | s |
| 18 | 28.2 | 1.32 | s |

TABLE 7.2-continued

NMR Spectra of Enzymatically Produced Rebaudioside M in C₅D₅N.

| Position | δ ¹³C, ppm | δ ¹H, ppm | ¹H Multiplicity (J, Hz) |
|---|---|---|---|
| 19 | | Null | |
| 20 | 16.7 | 1.41 | s |
| 1' | 94.9 | 6.44 | d (8.2) |
| 2' | 77 | 4.55 | m |
| 3' | 88.7 | 5.15 | t (8.5) |
| 4' | 70.1 | 4.22 | m |
| 5' | 78.6 | 4.15 | m |
| 6' | 61.7 | 4.22 | m |
| 6' | 61.7 | 4.35 | m |
| 1" | 96.3 | 5.52 | d (7.8) |
| 2" | 81.5 | 4.15 | m |
| 3" | 88 | 5.01 | obscured by water |
| 4" | 70.3 | 4.1 | m |
| 5" | 77.7 | 3.98 | m |
| 6" | 62.5 | 4.23 | m |
| 6" | 62.5 | 4.35 | m |
| 1''' | 104.7 | 5.52 | d (7.6) |
| 2''' | 75.8 | 4.2 | m |
| 3''' | 78.6 | 4.17 | m |
| 4''' | 73.2 | 4.01 | m |
| 5''' | 77.5 | 3.76 | ddd (3.1, 6.3, 9.5) |
| 6''' | 64 | 4.3 | m |
| 6''' | 64 | 4.53 | m |
| 1'''' | 104 | 5.49 | d (8.0) |
| 2'''' | 75.6 | 4 | m |
| 3'''' | 77.7 | 4.53 | m |
| 4'''' | 71.3 | 4.19 | m |
| 5'''' | 77.9 | 4.02 | m |
| 6'''' | 62.1 | 4.24 | m |
| 6'''' | 62.1 | 4.35 | m |
| 1''''' | 104.2 | 5.86 | d (7.5) |
| 2''''' | 75.5 | 4.24 | m |
| 3''''' | 78.4 | 4.24 | m |
| 4''''' | 73.6 | 4.14 | m |
| 5''''' | 77.8 | 3.94 | ddd (3.0, 6.6, 9.6) |
| 6''''' | 64 | 4.36 | m |
| 6''''' | 64 | 4.65 | d (9.1) |
| 1'''''' | 104.2 | 5.34 | d (8.1) |
| 2'''''' | 75.5 | 3.98 | m |
| 3'''''' | 78 | 4.4 | m |
| 4'''''' | 71.1 | 4.15 | m |
| 5'''''' | 78.1 | 3.88 | m |
| 6'''''' | 62 | 4.14 | m |
| 6'''''' | 62 | 4.35 | m |

Example 8

ADP-Glycosyltransferase Variants of SEQ ID NO: 232

In this Example, experiments for evolution and screening of GT polypeptides derived from SEQ ID NO: 232 for improved glucosylation of steviol glycosides using ADP-glucose are described. Directed evolution of the GT encoded by SEQ ID NO:231 (i.e., SEQ ID NO:232) was carried out by constructing a library in which surface residue mutations associated with improved activity in round 3 were recombined. This library was then plated, grown, and screened using the high-throughput (HTP) assay described below to provide a fourth round ("Round 4") of 76 engineered GT variant polypeptides with glucosyltransferase activity toward ADP-glucose and steviol glycosides.

HTP Assay for Glucose Transfer from ADP-Glucose to Rebaudioside D

Assays were performed on 96-well plates of cleared *E. coli* culture lysates expressing SEQ ID NO: 232 variants with lysate loading of 2.5 µL lysate in 100 µL reactions and with substrate loading of 0.5 mM rebaudioside D (Chroma-Dex, >94% purity), from a 20 mM stock solution in 50% ethanol and co-substrate loading of 0.5 mM ADP-glucose (Sigma, >93% purity). The following reaction conditions were used: 50 mM Tris-HCl buffer, pH 7.5, 3 mM MgCl₂, 30° C. in a Thermotron® titre-plate shaker with 300 RPM shaking for 1 h. The reactions were quenched by diluting the assay 1:10 and then quenching with 50 µL/well acetonitrile with 0.2% formic acid, centrifuged 10 m at 4° C., and the supernatants were diluted 1:10 in water and analyzed by HPLC-MS/MS as described in Example 1, Table 1.1.

The engineered polypeptides are listed in Table 8.1. Although the parent and variant constructs contain an N-terminal histidine tag for affinity purification, the mutations were numbered relative to the untagged reference sequence for clarity. Shake-flask scale cultures were grown, lysed, and lyophilized to powder as described in Example 1 for variants with SEQ ID NOS: 348, 350, 352, 354, 356, 364, 408, and 428.

TABLE 8.1

Round 4 Variants and RebM Levels

| SEQ ID NO: (nt/aa) | Amino Acid Differences (Relative to SEQ ID NO: 232) | Increased RebM[a] |
|---|---|---|
| 347/348 | L109R/S131P/R139P/S179V/R261P/Y396R/Y421V | +++ |
| 349/350 | L106T/L109R/R139P/G347D/E417A/Y421V/R427A | +++ |
| 351/352 | L109R/E112P/S179V/G204D/I233R/E417A/Y421V/R427L | +++ |
| 353/354 | F64P/L109R/E112P/R139P/E417A | ++ |
| 355/356 | L106S/L109R/E112P/S131P/Q159R/G204D/G347D/E417A/Y421V/R427L | ++ |
| 357/358 | L109R/E112P/R139P/S179V/E417R/R427A | ++ |
| 359/360 | F64P/L106S/R139P/S179L/I233R/E417A/R427A/Q431D | ++ |
| 361/362 | F64P/L106S/L109R/R139P/S179L/E417R/Y421V/R427L/Q431D | ++ |
| 363/364 | L106S/L109R/E112P/S131P/Q159R/S179L/E417A/Y421V | ++ |
| 365/366 | F64P/L109R/R139P/I233R/E417R/Y421V | ++ |
| 367/368 | L106S/E112P/Q159R/G204D/I233R/E417R/Y421V/R427A/Q431D | ++ |
| 369/370 | L106S/L109R/E112P/R261P/E417R/Q431D | ++ |
| 371/372 | L106S/E417A | ++ |
| 373/374 | L109R/E112P/Q159R/S179V/E417R/Y421V | ++ |
| 375/376 | L106T/G347D/E417R/R427A/Q431D | ++ |
| 377/378 | F64P/L109R/E112P/R139P/Q159R/S179L/E417R/Q431D | ++ |
| 379/380 | E112P/S131P/S179L/G347D/E417R/Y421V | ++ |
| 381/382 | F64P/L106T/E112P/Q159R/S179L/E417R/Y421V | ++ |
| 383/384 | F64P/L106S/L109R/E112P/E417A/Y421V/R427A/Q431D | + |
| 385/386 | L106S/L109R/E112P/G347D/R427A | + |
| 387/388 | F64P/R139P/G347D/E417R/Y421V/R427L/Q431D | + |
| 389/390 | F64P/L109R/Q159R/S179V/G204D/I233R/E417R/Y421V | + |
| 391/392 | F64P/L106T/G204D/E417A/Y421V/R427A | + |
| 393/394 | S179V/E417R/Y421V | + |
| 395/396 | F64P/L106S/E417R/Y421V | + |
| 397/398 | E112P/Q159R/E417R/Y421V | + |
| 399/400 | L109R/E112P/E417A/R427A/Q431D | + |
| 401/402 | L106S/E112P/I233R/E417R | + |
| 403/404 | L109R/E112P/I233R/E417A/Q431D | + |
| 405/406 | L109R/E112P/S131P/Q159R/E417R/Y421V | + |
| 407/408 | L109R/R139P/S179L/E417R/Y421V/R427A | + |
| 409/410 | L106T/R139P/Y421V | + |
| 411/412 | L109R/E112P/E417A/Y421V/R427L | + |
| 413/414 | E112P/E417R/Y421V | + |
| 415/416 | F64P/R139P/I233R/E417R/R427L/Q431D/K439P | + |
| 417/418 | L106T/E112P/Q159R/S179L/G204D/E417A/Y421V | + |
| 419/420 | I233R/E417R/Y421V/R427L/Q431D | + |

TABLE 8.1-continued

Round 4 Variants and RebM Levels

| SEQ ID NO: (nt/aa) | Amino Acid Differences (Relative to SEQ ID NO: 232) | Increased RebM[a] |
|---|---|---|
| 421/422 | L106S/I233R/Y421V/R427A | + |
| 423/424 | L109R/S179V/I233R/Y421V | + |
| 425/426 | F64P/L106T/E112P/R139P/Q159R/S179V/ G204D/Y396R/E417A | + |
| 427/428 | L109R/G204D/E417R/Q431D | + |
| 429/430 | F64P/L109R/E417R/Y421V | + |
| 431/432 | L109R/E112P/S179V/G347D/E417R | + |
| 433/434 | F64P/L106S/L109R/I233R/G347D/R427A/ Q431D | + |
| 435/436 | L106S/L109R/R139P/R427A/Q431D | + |
| 437/438 | L106S/R139P/Q159R/I233R/G347D/E417R/ Y421V/R427A/Q431D | + |
| 439/440 | L106S/E112P/Y396R/E417R/Y421V | + |
| 441/442 | L106S/L109R/E112P/G204D/G347D/ Y421V/K439P | + |
| 443/444 | R139P/I233R/E417A | + |
| 445/446 | L109R/E417R/Y421V | + |
| 447/448 | L109R/E417R/R427A/Q431D | + |
| 449/450 | L109R/S131P/G204D | + |
| 451/452 | G347D/E417R | + |
| 453/454 | L106T/L109R/R139P/E417R | + |
| 455/456 | L106T/L109R/I233R/R427A/Q431D | + |
| 457/458 | L106S/L109R/E417R/Y421V/R427L | + |
| 459/460 | L109R/E112P/G204D/I233R/E417R | + |
| 461/462 | Q159R/G347D/E417R/Y421V/Q431D | + |
| 463/464 | L106T/L109R | + |
| 465/466 | L109R/E112P/S131P/Q159R/S179V/K439P | + |
| 467/468 | F64P/L106S/E112P/G347D/E417A/Y421V | + |
| 469/470 | L109R/E112P/Q159R/E417R/R427L | + |
| 471/472 | L109R/E112P/G204D/R427A | + |
| 473/474 | F64P/L106T/L109R/E112P/S131P/S179L/ E417R/R427A/Q431D | + |
| 475/476 | F64P/L106S/Q431D | + |
| 477/478 | F64P/E417R/Y421V/Q431D | + |
| 479/480 | L106T/L109R/R139P/I233R/E417R/Y421V | + |
| 481/482 | E112P/S131P/S179V/G204D/E417R/Y421V/ R427L | + |
| 483/484 | L106T/E112P/Q159R/S179V/I233R/E417A/ Y421V/R427L/K439P | + |
| 485/486 | F64P/L106S/L109R/E112P/S131P/Q159R/ I233R/Y421V/R427L/Q431D | + |
| 487/488 | S131P/S179L/I233R/E417R/R427A | + |
| 489/490 | F64P/L109R/E417A/Y421V | + |
| 491/492 | L109R/R139P/S179L/E417R/R427L | + |
| 493/494 | F64P/L106T/L109R/E417A/Y421V/R427L/ Q431D/K439P | + |
| 495/496 | E112P/R139P/S179V/G204D/I233R/G347D/ R427L | + |
| 497/498 | L106T/S131P/S179L/I233R/Y421V/R427L/ Q431D | + |

[a]Levels of increased production were determined relative to the reference polypeptide of SEQ ID NO: 232, and defined as follows:
"+" = production at least 1.6-fold, but less than 2-fold;
"++" = at least 2-fold, but less than 2.4-fold; and
"+++" = at least 2.4-fold increased production, as compared to the reference polypeptide.

Shake Flask Powder Characterization Assay and Analysis for Glucosyl Transfer from ADP-Glucose to Stevioside or Rebaudioside D A time course experiment was performed to characterize the activity of the engineered round 4 variants on stevioside and rebaudioside D. One g/L shake flask powder (SFP) was added to a 100 µL total reaction volume containing 50 mM Tris-HCl buffer, pH 7.5, 3 mM MgCl$_2$, 2.5% v/v ethanol with 1 mM stevioside (Chromadex, >94% purity) or rebaudioside D (ChromaDex, >93% purity) and 1 mM ADP-glucose. The reaction was performed at 30° C. in a Thermotron® titre-plate shaker with 300 RPM shaking for 0.5-2 h. The reaction was quenched by adding 50 µL acetonitrile with 0.2% formic acid and precipitated by centrifugation. The supernatant was diluted 1:50 in water and analyzed for steviol glycosides by LC-MS/MS as described in Example 1, Table 1.1. All 8 variants had higher activities on both stevioside and rebaudioside D than SEQ ID NO: 232. The levels of rebaudioside A produced from stevioside by the variants relative to SEQ ID NO: 232 at the 1 hour time point are listed in Table 8.2.

TABLE 8.2

Round 4 Variant SFP Activity on Stevioside

| SEQ ID NO: (nt/aa) | Amino Acid Differences Increased (Relative to SEQ ID NO: 232) | RebA[a] |
|---|---|---|
| 355/356 | L106S/L109R/E112P/S131P/Q159R/G204D/ G347D/E417A/Y421V/R427L | +++ |
| 351/352 | L109R/E112P/S179V/G204D/I233R/E417A/ Y421V/R427L | ++ |
| 427/428 | L109R/G204D/E417R/Q431D | ++ |
| 347/348 | L109R/S131P/R139P/S179V/R261P/Y396R/ Y421V | ++ |
| 363/364 | L106S/L109R/E112P/S131P/Q159R/S179L/ E417A/Y421V | ++ |
| 349/350 | L106T/L109R/R139P/G347D/E417A/Y421V/ R427A | + |
| 407/408 | L109R/R139P/S179L/E417R/Y421V/R427A | + |
| 353/354 | F64P/L109R/E112P/R139P/E417A | + |

[a]Levels of increased production were determined relative to the reference polypeptide of SEQ ID NO: 232, at the 1 h time point and defined as follows:
"+" = production at least 1.5-fold, but less than 2-fold;
"++" = at least 2-fold, but less than 3-fold; and
"+++" = at least 3-fold increased production, as compared to the reference polypeptide.

The activities of the 8 engineered variants were clearly higher on rebaudioside D than the activity of SEQ ID NO: 232, but they were not well distinguished from each other in the time curse. Therefore, a follow-up experiment was performed as follows: A dose response curve of 0.03-1 g/L shake flask powder (SFP) was added to a 100 µL total reaction volume containing 50 mM Tris-HCl buffer, pH 7.5, 3 mM MgCl$_2$, 2.5% v/v ethanol with 1 mM rebaudioside D (ChromaDex, >93% purity) and 1 mM ADP-glucose. The reaction was performed at 30° C. in a Thermotron® titre-plate shaker with 300 RPM shaking for 0.5 h. The reaction was quenched by adding 50 µL acetonitrile with 0.2% formic acid and precipitated by centrifugation. The supernatant was diluted 1:67 in water and analyzed for steviol glycosides by LC-MS/MS as described in Example 1, Table 1.1. The activities of the round 4 variants on rebaudioside D at 0.0625 g/L SFP loading are listed in Table 8.3.

TABLE 8.3

Round 4 Variant SFP Activity on Rebaudioside D

| SEQ ID NO: (nt/aa) | Amino Acid Differences Increased (Relative to SEQ ID NO: 232) | RebM[a] |
|---|---|---|
| 349/350 | L106T/L109R/R139P/G347D/E417A/Y421V/ R427A | + |
| 407/408 | L109R/R139P/S179L/E417R/Y421V/R427A | − |
| 355/356 | L106S/L109R/E112P/S131P/Q159R/G204D/ G347D/E417A/Y421V/R427L | − |
| 353/354 | F64P/L109R/E112P/R139P/E417A | + |
| 347/348 | L109R/S131P/R139P/S179V/R261P/Y396R/ Y421V | +++ |
| 363/364 | L106S/L109R/E112P/S131P/Q159R/S179L/ E417A/Y421V | − |

[a]Levels of increased production were measured as µmol RebM/mg SFP-min at 0.0625 g/L SFP and 30 min and defined relative to SEQ ID NO: 232, as follows:
"+" = production at least that of the reference polypeptide, but less than 2-fold;
"++" = at least 2-fold, but less than 3-fold;
"+++" = at least 3-fold, but less than 4-fold; and
"++++" = at least 4-fold increased production, as compared to the reference polypeptide.

Example 9

ADP-Glycosyltransferase Variants of SEQ ID NO: 348

In this Example, experiments for evolution and screening of GT polypeptides derived from SEQ ID NO: 348, for improved glucosylation of steviol glycosides using ADP-glucose are described. Directed evolution of the GT encoded by SEQ ID NO:347 (i.e., SEQ ID NO:348) was carried out by constructing libraries in which mutations associated with improved activity in previous rounds were recombined and in which mutations identified from homologs in publically available databases were recombined. These libraries were then plated, grown, and screened using the high-throughput (HTP) assay described below to provide a fifth round ("Round 5") of engineered GT variant polypeptides, 6 from library 5.01 (Table 9.1) and 18 from the remaining libraries in the round (Table 9.2), with glucosyltransferase activity toward ADP-glucose and steviol glycosides.

HTP Assay for Glucose Transfer from ADP-Glucose to Steviol Glycosides

Assays were performed on 96-well plates of cleared *E. coli* culture lysates expressing SEQ ID NO: 348 variants. Lysis buffer volume was increased to 400 uL from the 250 uL used in previous rounds, and the lysate was diluted 10-fold. For round 5.01, assays were conducted with 10 μL lysate in 100 μL reactions and with substrate loading of 1 mM stevioside (ChromaDex, >94% purity), from a 20 mM stock solution in 50% ethanol and co-substrate loading of 1 mM ADP-glucose (Sigma, >93% purity). The following reaction conditions were used: 50 mM Tris-HCl buffer, pH 7.5, 3 mM $MgCl_2$, 40° C. in a Thermotron® titre-plate shaker with 300 RPM shaking for 1 h. The reactions were quenched by adding 10 μl assay 90 μL acetonitrile with 0.2% formic acid and centrifuged 10 m at 4° C. The supernatants were diluted 1:10 in water and analyzed by RapidFire SPE-MS/MS (Agilent) as described in Table 9.3. For the remaining round 5 libraries, the lysate was diluted 4-fold instead of 10-fold, 50 mM potassium phosphate buffer pH 7 was used instead of Tris-HCl, the temperature was 50° C., the reaction time was 2h, and the assay was performed with both stevioside and rebaudioside D (Chromadex, >93%).

The engineered polypeptides are listed in Table 9.1 and Table 9.2. Although the parent and variant constructs contain an N-terminal histidine tag for affinity purification, the mutations were numbered relative to the untagged reference sequence for clarity. Shake-flask scale cultures were grown, lysed, and lyophilized to powder as described in Example 1 for SEQ ID NO: 500.

TABLE 9.1

Round 5.01 Variants and RebA Levels

| SEQ ID NO: (nt/aa) | Amino Acid Differences (Relative to SEQ ID NO: 348) | Increased RebA[a] |
|---|---|---|
| 499/500 | L106S/E112P/G204D/G347D/R396Y/E417R/R427A/Q431D | +++ |
| 501/502 | G204D/G347D/R396Y/E417R/Q431D | ++ |
| 503/504 | L106S/E112P/G204D/G347D/R396Y/E417R/R427A | ++ |
| 505/506 | E112P/G204D/G347D/R396Y/E417R/R427A/Q431D | + |
| 507/508 | L106S/E112P/G204D/G347D/R396Y/E417R | + |
| 509/510 | E112P/G204D/G347D/R396Y/E417R/R427A | + |

[a]Levels of increased production were determined relative to the reference polypeptide of SEQ ID NO: 348, and defined as follows: "+" = production at least 10-fold that of the reference polypeptide, but less than 20-fold; "++" = at least 20-fold, but less than 30-fold; and "+++" = at least 30-fold increased production, as compared to the reference polypeptide.

TABLE 9.2

Additional Round 5 Variants and RebA and RebM Levels

| SEQ ID NO: (nt/aa) | Amino Acid Differences (Relative to SEQ ID NO: 348) | Increased RebA[a] | Increased RebM[b] |
|---|---|---|---|
| 511/512 | N137G/D161L/V435R | ++++ | ++++ |
| 513/514 | K38R/A178V/W401L | ++ | ++++ |
| 515/516 | R74W/R102K/N137G/D161L/H259S/K289S | ++ | + |
| 517/518 | I14V/L100F | ++ | ++++ |
| 519/520 | D290E/A351G/W401L | ++ | +++ |
| 521/522 | I28M/I44V/V365I/A407E | ++ | +++ |
| 523/524 | K185R/D290E/W401L/I422M | ++ | ++ |
| 525/526 | D98P/I233W | ++ | +++ |
| 527/528 | T54P/V413L | ++ | +++ |
| 529/530 | R102K/D161L/T250A/V435E | ++ | ++ |
| 531/532 | I92L/S118A | ++ | ++ |
| 533/534 | K38R/S118A/D290E/A351G/D375P/W401L/I422M | ++ | ++ |
| 535/536 | N137G/D169G | + | ++ |
| 537/538 | K38R/D290E/A351G/W401L/I422M | + | + |
| 539/540 | V435Q/M438A | + | ++ |
| 541/542 | Q159M/D169S/R173G/D300Q/Q424E/M438A | + | + |
| 543/544 | S118A/S156A/A178V/D290E/D375P/W401L/I422M | + | ++ |
| 545/546 | A110G/K222R/T250R/H259P/V435G | + | + |

[a]Levels of increased RebA production were determined relative to the reference polypeptide of SEQ ID NO: 348, and defined as follows: "+" = production at least that of the reference polypeptide, but less than 3-fold; "++" = production at least 3-fold, but less than 6-fold; "+++" = at least 6-fold, but less than 9-fold; and "++++" = at least 9-fold increased production, as compared to the reference polypeptide.
[b]Levels of increased RebM production were determined relative to the reference polypeptide of SEQ ID NO: 348, and defined as follows: "+" = production at least that of the reference polypeptide, but less than 15-fold; "++" = production at least 15-fold, but less than 30-fold; "+++" = at least 30-fold, but less than 45-fold; and "++++" = at least 45-fold increased production, as compared to the reference polypeptide.

TABLE 9.3

RapidFire SPE-MS/MS Conditions for Steviol Glycoside Detection.

| Agilent RapidFire Conditions | |
|---|---|
| Buffer A | 0.1% formic acid in LC/MS grade water; 1.5 mL/min flow rate |
| Buffer B | 0.1% formic acid in LC/MS grade methanol; 0.5 mL/min flow rate |
| Aqueous wash | Water |
| Organic wash | Acetonitrile |
| SPE cartridge | Agilent RapidFire cartridge A (C4) |
| RF state 1 | 600 ms |
| RF state 2 | 2500 ms |
| RF state 3 | 0 |
| RF state 4 | 5000 ms |
| RF state 5 | 1000 ms |

| Agilent Jet Stream source parameters | |
|---|---|
| Drying gas temperature | 325° C. |
| Drying gas flow | 7 L/min |
| Nebulizer pressure | 50 psi |
| Sheath gas temperature | 300° C. |

TABLE 9.3-continued

RapidFire SPE-MS/MS Conditions for Steviol Glycoside Detection.

| | |
|---|---|
| Sheath gas flow | 12 L/min |
| Capillary voltage | +4000 V |
| Nozzle voltage | +500 V |

Agilent 6470 Triple Quadrupole MRM parameters

| Compound | Q1 | Q3 | Dwell | Fragmentor | CE | CAV |
|---|---|---|---|---|---|---|
| Stevioside | 827.4 | 665.3 | 50 | 150 | 50 | 5 |
| RebA | 989.5 | 827.5 | 50 | 300 | 60 | 5 |
| RebD or RebI | 1151.7 | 827.5 | 50 | 285 | 55 | 5 |
| RebM | 1313.7 | 827.5 | 50 | 350 | 70 | 5 |

Shake Flask Powder Characterization Assay and Analysis for Glucosyl Transfer from ADP-Glucose to Stevioside or Rebaudioside D A shake flask powder loading dose response experiment was performed to characterize activity of the engineered round 5 variant SEQ ID NO: 500 relative to SEQ ID NO: 348 on stevioside and rebaudioside D. Levels of 0.03-1 g/L shake flask powder (SFP) were added to a 100 µL total reaction volume containing 50 mM Tris-HCl buffer, pH 7.5, 3 mM MgCl$_2$, 2.5% v/v ethanol with 1 mM stevioside (Chromadex, >94% purity) or rebaudioside D (ChromaDex, >93% purity) and 1 mM ADP-glucose. The reaction was performed at 40° C. in a thermocycler for 0.5 h, and the reaction was quenched with 50 µL acetonitrile with 0.2% formic acid and precipitated by centrifugation. The supernatant was diluted 1:67 in water and analyzed for steviol glycosides by LC-MS/MS as described in Example 1, Table 1.1. At 1 g/L loading, SEQ ID NO: 500 produced >1.2-fold as much rebaudioside A from stevioside as SEQ ID NO: 348, and >1.07-fold as much rebaudioside M from rebaudioside D. Subsequently, SEQ ID NO: 499 (i.e., 500) was re-cloned to omit the N-terminal histidine tag, expressed in high throughput, and the plates were lysed in 400 µL. The resulting powder, containing the variant SEQ ID NO: 548, was assayed relative to the SEQ ID NO: 500 variant, with 2.5 µL lysate added to a 100 µL total reaction volume containing 50 mM potassium phosphate buffer, pH7, 3 mM MgCl$_2$, 2.5% v/v ethanol with 1 mM stevioside (Chromadex, >94% purity) or rebaudioside D (ChromaDex, >93% purity) and 1 mM ADP-glucose. The reaction was performed at 50° C. in a Thermotron® shaking incubator at 300 RPM for 4 h, and the reaction was quenched by adding 10 µL assay to 90 µL acetonitrile with 0.2% formic acid and precipitated by centrifugation. The supernatant was diluted 1:10 in water and analyzed for steviol glycosides by Rapid-Fire SPE-MS/MS as described in Table 9.3. Under these conditions, the SEQ ID NO: 548 variant produced nearly 1.5-fold more rebaudioside A from stevioside as the SEQ ID NO: 500 variant, and over 1.6-fold more rebaudioside M from rebaudioside D.

Subsequently, shake flask powder was prepared containing the variant of SEQ ID NO: 548, and it was assayed relative to the SEQ ID NO: 348 variant. Levels of 0.25-10 g/L shake flask powder (SFP) were added to a 100 µL total reaction volume containing 50 mM potassium phosphate buffer, pH 7, 3 mM MgCl$_2$, 2 mM ADP-glucose, and 1 g/L rebaudioside A 60 (60% rebaudioside A, >35% stevioside) or rebaudioside D (Chromadex, >93% purity). The reaction was performed at 40° C. in a thermocycler for 1 h, and the reaction was quenched by adding 10 µL assay to 90 µL acetonitrile with 0.2% formic acid and precipitated by centrifugation. The supernatant was diluted 1:10 in water and analyzed for steviol glycosides by LC-MS/MS as described in Example 1, Table 1.1. The SEQ ID NO: 548 variant reached >65% conversion of rebaudioside A 60 to a mixture of rebaudioside A and rebaudioside I and nearly complete conversion of rebaudioside D to rebaudioside M. At 0.25 g/L shake flask powder loading, the SEQ ID NO: 548 variant reached 1.4-fold the conversion of rebaudioside D as the SEQ ID NO: 348 variant, and 2.2-fold the conversion of rebaudioside A 60.

Expression Analysis of AGT Enzymes

The six rounds of engineered AGT polypeptides for β-1,3-glucosylation of steviol glycosides were analyzed by polyacrylamide gel-electrophoresis to determine relative protein expression levels. Samples were prepared with 1×LDS loading buffer and 1× reducing agent (Life Technologies). A 4-12% Bis-Tris acrylamide gel (Life Technologies) was loaded with 5 µg per lane of lyophilized soluble crude lysate from shake flask scale cultures and run with MES running buffer for 25 min at 200 V, and bands were quantified using Image J analysis software. The relative expression levels are listed in Table 9.4. SEQ ID NOs: 547/548, 499/500, and 347/348 are significantly better expressed genes and/or significantly better folded/more stable proteins. Thus, these genes produced more protein than the wild-type gene.

TABLE 9.4

Protein Levels of Engineered AGT Variants

| SEQ ID NO: | Increased Protein[a] |
|---|---|
| 548 | +++ |
| 500 | ++ |
| 348 | ++ |
| 232 | + |
| 32 | − |
| 8 | − |

[a]Levels of increased protein were determined relative to the reference polypeptide of SEQ ID NO: 4 and defined as follows: "+" = band intensity at least that of the reference polypeptide, but less than 2-fold; "++" = band intensity at least 2-fold, but less than 4-fold; and "+++" = at least 4-fold increased band intensity, relative to the reference polypeptide.

Example 10

Transformation of Rebaudioside A to Rebaudioside I with AGT (SEQ ID NO: 500)

Figure 3:
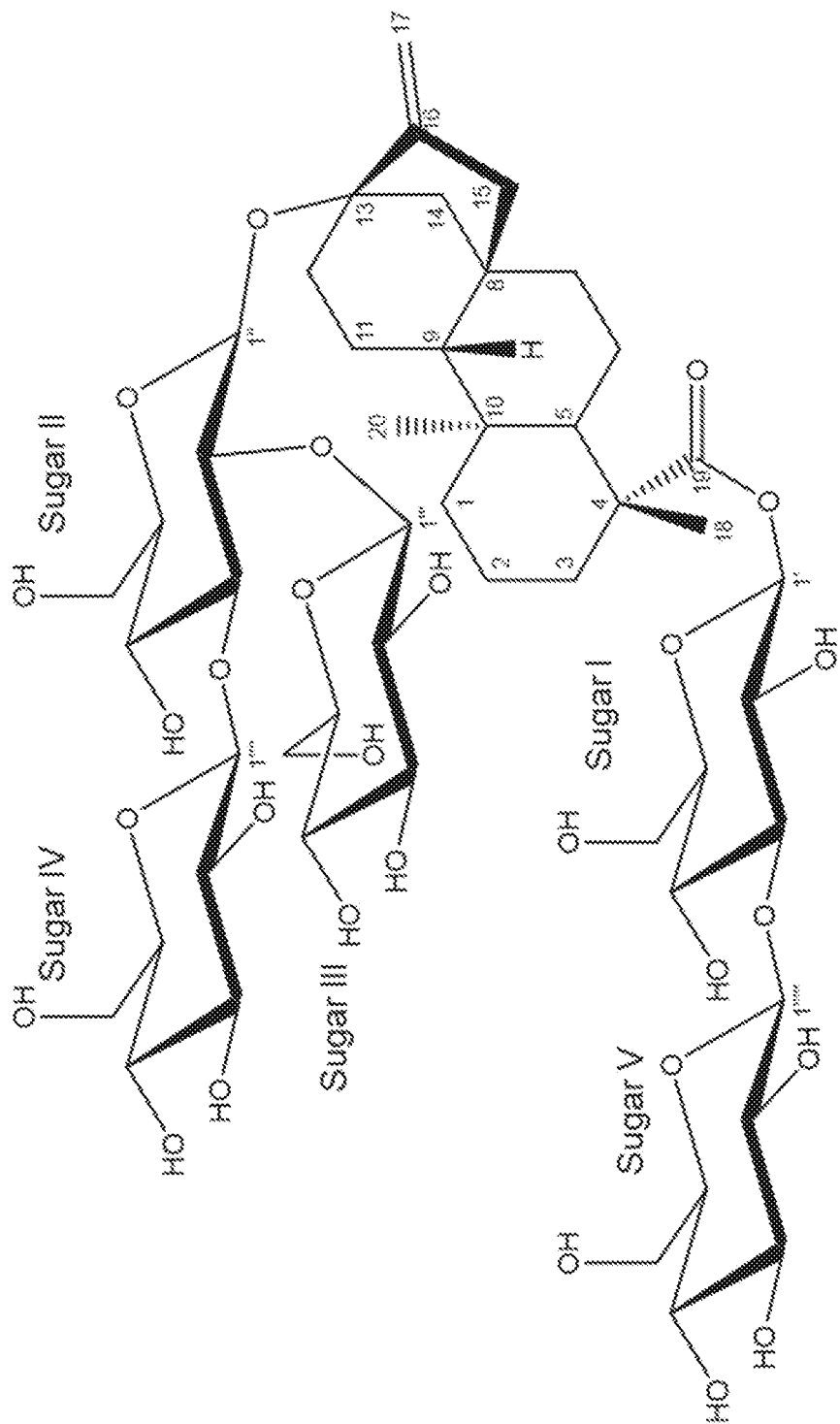
FIG. 3 provides the structure of rebaudioside I with the carbons numbered.

In this Example, scale-up of the reaction transforming rebaudioside A to rebaudioside I using the SEQ ID NO: 500 variant, and the isolation and characterization of rebaudioside I are described. A reaction containing 5 g/L of the SEQ ID NO: 500 variant lyophilized shake flask powder, 50 mM potassium phosphate buffer pH 7, 10.3 mM magnesium chloride, 10 g/L rebaudioside A (>97% purity), and 10.3 mM ADP-glucose (Sigma) with 10 mL total volume was stirred on a stir plate at 300 RPM and 35° C. for 89 h. The reaction was transparent when it was begun, and by the end of the reaction it was a white emulsion. The assay was diluted 1:10 in water, and 10 µL of diluted assay was added to 90 µL acetonitrile with 0.2% formic acid and precipitated by centrifugation. The supernatant was diluted 1:10 in water and analyzed for steviol glycosides by LC-MS/MS as described in Example 1, Table 1.1. This analysis confirmed production of rebaudioside I at high conversion. Because of its low solubility, rebaudioside I settled. Therefore, the isolation was conducted by removing the supernatant, resuspending the sediment with the minimal volume of water, and centrifuging. This wash step was repeated twice, and a brown sediment at the surface of the white sediment was scraped off. The material was lyophilized and analyzed by Acorn NMR. The material was dissolved in pyridine-d5, and $^1$H 1-D, $^{13}$C DEPT-135, $^1$H-$^{13}$C HSQC NMR experiments were performed with a Varian Inova 500 NMR spectrometer. The NMR spectra were completely consistent with literature reports for rebaudioside I (see Table 10.1). See FIG. 3 for the structure of rebaudioside I with carbons numbered.

TABLE 10.1

NMR Characterization of Rebaudioside I

| Position | δ $^{13}$C, ppm[a] | δ $^1$H, ppm | $^1$H Multiplicity (J,Hz) |
|---|---|---|---|
| 1 | 40.4 | 0.73 | t(13.4) |
| 1 | 40.4 | 1.74 | m |
| 2 | 19.1 | 1.42 | m |
| 2 | 19.1 | 2.18 | m |
| 3 | 38.2 | 1.02 | M |
| 3 | 38.2 | 2.35 | m |
| 4 | — | — | |
| 5 | 57 | 1.03 | m |
| 6 | 21.9 | 1.88 | m |
| 6 | 21.9 | 2.32 | m |
| 7 | 41.5 | 1.29 | m |
| 7 | 41.5 | 1.31 | m |
| 8 | — | — | |
| 9 | 53.9 | 0.88 | d(7.2) |
| 10 | — | — | |
| 11 | 20.3 | 1.69 | m |
| 11 | 20.3 | 1.7 | m |
| 12 | 37 | 1.97 | m |
| 12 | 37 | 2.27 | m |
| 13 | — | — | |
| 14 | 44.1 | 1.79 | m |
| 14 | 44.1 | 2.59 | d(11.9) |
| 15 | 47.4 | 2.05 | Brs |
| 16 | — | — | |
| 17 | 104.5 | 5.02 | s |
| 17 | 104.5 | 5.66 | s |
| 18 | 28.1 | 1.22 | s |
| 19 | — | — | |
| 20 | 15.4 | 1.27 | s |
| 1' | 95 | 6.14 | d(8.2) |
| 2' | 72.3 | 4.17 | m |
| 3' | 89.4 | 4.25 | m |
| 4' | 69 | 4.23 | m |
| 5' | 77.8 | 3.91 | m |
| 6' | 61.4 | 4.33 | m |
| 6' | 61.4 | 4.25 | m |
| 1'' | 97.8 | 5.05 | d(7.8) |
| 2'' | 80.4 | 4.32 | m |
| 3'' | 87.5 | 4.17 | m |
| 4'' | 69.9 | 3.95 | m |
| 5'' | 77.3 | 3.79 | m |
| 6'' | 62.3 | 4.16 | m |
| 6'' | 62.3 | 4.49 | m |
| 1''' | 104.4 | 5.55 | d(7.7) |
| 2''' | 76 | 4.18 | m |
| 3''' | 78.3 | 4.26 or 4.23 | m |
| 4''' | 71.9 | 4.22 | m |
| 5''' | 78.5 | 3.92 | m |
| 6''' | 62.9 | 4.39 | m |
| 6''' | 62.9 | 4.51 | m |
| 1'''' | 104.5 | 5.35 | d(7.9) |
| 2'''' | 75.1 or 75.3 | 4.03 | m |
| 3'''' | 78.3 | 4.26 | m |
| 4'''' | 71.2 or 71.4 | 4.12 | m |
| 5'''' | 78.3 | 4.11 | m |
| 6'''' | 62.1 | 4.24 | m |
| 6'''' | 62.1 | 4.56 | m |
| 1''''' | 104.8 | 5.26 | d(7.9) |
| 2''''' | 75.1 or 75.3 | 4.03 | M |
| 3''''' | 78.3 | 4.26 or 4.23 | M |
| 4''''' | 71.2 or 71.4 | 4.12 | M |
| 5''''' | 78.3 | 4 | M |
| 6''''' | 62.2 | 4.24 | M |
| 6''''' | 62.2 | 4.54 | M |

[a]Dried material was characterized by $^1$H, DEPT-135, and HSQC in pyridine-d5 on a Varian Inova 500 NMR instrument. The spectra were compared to literature spectra (See e.g., Prakash et al., Molecules, 19(11): 17345-55 [2014]) in order to assign peaks. $^{13}$C signals are from DEPT-135. Some peaks were too close in shift to determine assignment; when this occurred both options are listed.

Example 11

ADP-Glycosyltransferase Variants of SEQ ID NO: 548

In this Example, experiments for evolution and screening of GT polypeptides derived from SEQ ID NO: 548 for improved glucosylation of steviol glycosides using ADP-glucose are described. Directed evolution of the GT encoded by SEQ ID NO:547 (i.e., SEQ ID NO:548) was carried out by constructing libraries in which mutations associated with improved activity in previous rounds were recombined. This library was then plated, grown, and screened using the high-throughput (HTP) assay described below to provide a sixth round ("Round 6") of 66 engineered GT variant polypeptides with glucosyltransferase activity toward ADP-glucose and steviol glycosides (Table 11.1).

HTP Assay for Glucose Transfer from ADP-Glucose to Steviol Glycosides

Assays were performed on 96-well plates of cleared E. coli culture lysates expressing SEQ ID NO: 548 variants. Lysis buffer volume was 400 uL, and the lysate was diluted 4-fold. The assay was conducted with 10 μL lysate in 100 μL reactions and with substrate loading of 1 mM stevioside (ChromaDex, >94% purity), from a 20 mM stock solution in 50% ethanol and co-substrate loading of 1 mM ADP-glucose (Sigma, >93% purity). The following reaction conditions were used: 50 mM potassium phosphate buffer, pH 7, 3 mM $MgCl_2$, 50° C. in a Thermotron® titre-plate shaker with 300 RPM shaking for 4 h. The reactions were quenched by adding 10 μl assay 90 μL acetonitrile with 0.2% formic acid and centrifuged 10 m at 4° C. The supernatants were diluted 1:10 in water and analyzed by RapidFire SPE-MS/MS as described in Table 9.3. The top 84 variants were retested with the same conditions using 1 mM stevioside (Chromadex, >94% purity), 1 mM rebaudioside A (>97% purity), or rebaudioside D (Chromadex, >93% purity). The resulting engineered GT variant polypeptides are listed in Table 11.1. Shake-flask scale cultures were grown, lysed, and lyophilized to powder as described in Example 1 for variants with SEQ ID NOS: 554, 562, 568, and 576.

TABLE 11.1

Round 6 Variants and RebA, RebI, and RebM Levels

| SEQ ID NO: (nt/aa) | Amino Acid Differences (Relative to SEQ ID NO: 548) | Increased RebA$^a$ | Increased RebI$^a$ | Increased RebM$^a$ |
|---|---|---|---|---|
| 549/550 | I28M/R74W/D161L/D290E/V365I | +++ | +++ | + |
| 551/552 | I28M/I44V/I92L/D161L/K222R/D300Q/V413L | +++ | + | + |
| 553/554 | I28M/R74W/S156A/D161L/V365I/A407E | +++ | ++ | + |
| 555/556 | I28M/R74W/S156A/Q159M/D161L/A178V/ D300Q/V365I/V435Q/M438A | +++ | + | + |
| 557/558 | I14V/I28M/I92L/L100F/R102K/Q159M/ D161L/I233W/A351G/I422M | +++ | + | + |
| 559/560 | I14V/R74W/D161L/D375P/W401L | +++ | − | + |
| 561/562 | I14V/I28M/K38R/R74W/L100F/R102K/S118A/D161L/ D169G/A178V/I233W/T250R/A407E/I422M/M438A | +++ | + | + |
| 563/564 | I28M/K38R/I92L/D98P/L100F/R102K/S156A/D161L | +++ | + | + |
| 565/566 | I14V/I28M/I92L/L100F/R102K/Q159M/ D161L/D169S/I233W | +++ | − | + |
| 567/568 | I28M/I44V/S118A/S156A/D161L/K222R/ K289S/V435Q/M438A | +++ | + | − |
| 569/570 | I28M/I92L/L100F/R102K/A110G/D161L/ K185R/T250A/D300Q/D375P/V435Q | +++ | − | + |
| 571/572 | I14V/I28M/I44V/D161L/D169S | +++ | + | + |
| 573/574 | I28M/S156A/D161L/I233W/H259S/D300Q/V435R | +++ | ++ | + |
| 575/576 | I14V/I28M/T54P/D161L/K185R/V413L | +++ | ++ | + |
| 577/578 | I14V/I28M/K38R/L100F/R102K/A110G/ Q159M/D161L/I233W/H259S/D290E/ D300Q/A351G/V435Q | ++ | + | + |
| 579/580 | I28M/S156A/D161L/K185R/V435R/M438A | ++ | ++ | + |
| 581/582 | I28M/I92L/D98P/L100F/A110G/S156A/D161L/W401L | ++ | − | − |
| 583/584 | I28M/D98P/L100F/R102K/D161L/K185R/ A351G/W401L/V435E/M438A | ++ | − | + |
| 585/586 | I14V/I28M/L100F/N137G/S156A/D161L/ K222R/H259S/K289S/V365I/W401L/V435M/M438A | ++ | + | + |
| 587/588 | I14V/I28M/I92L/L100F/D161L/K222R/I233W/ K289S/D300Q | ++ | − | + |
| 589/590 | R102K/N137G/Q159M/D161L/I422M/Q424E | ++ | − | + |
| 591/592 | I14V/I28M/L100F/S156A/D161L/T250R | ++ | + | + |
| 593/594 | I14V/I28M/R74W/D98P/L100F/R102K/ D161L/R173G/A178V/I233W/T250A/H259S/ D290E/A407E | ++ | − | − |
| 595/596 | I14V/I28M/K38R/A110G/N137G/D161L/ K222R/K289S/W401L | ++ | − | − |
| 597/598 | I28M/T54P/I92L/Q159M/D161L/D290E | ++ | + | + |
| 599/600 | I14V/I28M/I44V/R74W/D98P/R102K/ N137G/Q159M/D161L/K185R/K222R/T250A | ++ | − | − |
| 601/602 | I14V/I28M/R102K/S118A/N137G/D161L/ K185R/K222R/T250R/H259P/W401L | ++ | − | + |
| 603/604 | Q159M/D161L/K222R/D290E/D375P/A407E | ++ | − | + |
| 605/606 | I14V/A110G/S156A/D161L/D375P/W401L/ V435E/M438A | ++ | − | + |
| 607/608 | I14V/I92L/D98P/L100F/Q159M/D161L/ H259P/V365I/I422M/Q424E/V435R | ++ | − | + |
| 609/610 | K38R/D161L/D300Q/M438A | ++ | − | + |
| 611/612 | R74W/S156A/D161L/R173G/A178V/Q424E/V435E | ++ | − | − |
| 613/614 | R74W/D98P/L100F/R102K/S118A/S156A/ Q159M/D161L/V435E/M438A | ++ | − | − |
| 615/616 | I14V/Q159M/D161L/V365I/V435E/M438A | ++ | − | − |
| 617/618 | N137G/Q159M/D161L/K185R/D300Q/ A351G/V365I/V435Q | ++ | − | − |
| 619/620 | I14V/R74W/A110G/Q159M/D161L/D169G/ R173G/T250A/H259P/D290E/D375P/A407E/I422M | ++ | − | − |
| 621/622 | I14V/D161L/K222R/T250R/H259S/K289S/ D375P/W401L/V413L | ++ | − | − |
| 623/624 | Q159M/D161L/W401L | ++ | − | − |
| 625/626 | I44V/R74W/L100F/R102K/D161L/I233W/ V365I/V435G/M438A | ++ | − | − |
| 627/628 | I14V/D161L/D300Q | + | − | − |
| 629/630 | I28M/I44V/R74W/W401L | + | + | − |
| 631/632 | I14V/D161L/K222R/T250R/V435Q/M438A | + | − | − |
| 633/634 | R74W/D98P/L100F/R102K/A110G/S118A/ D161L/A178V/T250R/K289S/D290E/ D300Q/V435E/M438A | + | − | − |
| 635/636 | S156A/Q159M/D161L/D169S | + | − | − |
| 637/638 | I14V/K38R/L100F/R102K/D161L/R173G/ A178V/K222R/T250R/D375P/W401L/V413L | + | − | − |
| 639/640 | D98P/L100F/S156A/Q159M/D161L/A178V/ H259S/K289S/D290E/A351G/I422M | + | − | − |
| 641/642 | I14V/K38R/R74W/A110G/S156A/D161L/ R173G/A178V/K222R/D300Q | + | − | − |

TABLE 11.1-continued

Round 6 Variants and RebA, RebI, and RebM Levels

| SEQ ID NO: (nt/aa) | Amino Acid Differences (Relative to SEQ ID NO: 548) | Increased RebA[a] | Increased RebI[a] | Increased RebM[a] |
|---|---|---|---|---|
| 643/644 | D98P/L100F/S118A/Q159M/D161L/D300Q | + | − | − |
| 645/646 | I14V/I28M/I92L/L100F/R102K/I422M/Q424E/V435Q | + | +++ | + |
| 647/648 | I14V/I28M/Q159M/V365I/V435Q | + | +++ | + |
| 649/650 | I28M/I92L/S118A/Q159M/K222R/T250R/H259P/D300Q/A407E | + | + | + |
| 651/652 | D161L/H259S/K289S/V435R/M438A | + | − | − |
| 653/654 | I28M | + | ++ | + |
| 655/656 | I28M/T54P/Q159M/D290E/M438A | + | ++ | + |
| 657/658 | I14V/I28M/Q159M/K289S/D290E/D300Q | + | ++ | + |
| 659/660 | I28M/I44V/K289S/D290E/A351G/I422M | + | +++ | + |
| 661/662 | I28M/I44V/V435R/M438A | + | ++ | + |
| 663/664 | I14V/I28M/I44V/I92L | + | ++ | + |
| 665/666 | I14V/I28M/A351G | + | ++ | + |
| 667/668 | I28M/I44V/D98P/L100F/R102K/S118A | + | ++ | + |
| 669/670 | I14V/I28M/I44V/D375P | + | + | + |
| 671/672 | I14V/I28M/T54P/V365I | + | +++ | + |
| 673/674 | I14V/I28M/K38R/R74W/R102K/S156A/Q159M/I233W/T250A/K289S/V413L/I422M/Q424E/V435R/M438A | + | ++ | + |
| 675/676 | R74W/D375P/V435G | + | − | − |
| 677/678 | S118A | + | + | − |
| 679/680 | I28M/T54P/T250R/K439N | − | ++ | + |

[a]Levels of increased production were determined relative to the reference polypeptide of SEQ ID NO: 548 and defined as follows: "−" = production less than that of the reference polypeptide; "+" = production at least that of the reference polypeptide, but less than 1.5-fold; "++" = at least 1.5-fold, but less than 2-fold; and "+++" = at least 2-fold increased production, as compared to the reference polypeptide.

Shake Flask Powder Characterization Assay and Analysis for Glucosyl Transfer from ADP-Glucose to Stevioside or Rebaudioside D A shake flask powder loading dose response experiment was performed to characterize activity of the engineered round 6 variants on stevioside and rebaudioside D. Levels of 0.03-1 g/L shake flask powder (SFP) were added to a 100 µL total reaction volume containing 50 mM potassium phosphate buffer, pH 7, 3 mM $MgCl_2$, 2.5% v/v ethanol with 1 mM stevioside (Chromadex, >94% purity) or rebaudioside D (ChromaDex, >93% purity) and 1 mM ADP-glucose. The reaction was performed at 50° C. in a Thermotron® titre-plate shaker at 300 RPM for 1h, and the reaction was diluted with 150 µL water and then quenched by transferring 12.5 µL into 87.5 µL acetonitrile with 0.2% formic acid and precipitated by centrifugation. The supernatant was diluted 1:20 in water and analyzed for steviol glycosides by Rapid-Fire SPE-MS/MS as described in Example 9, Table 9.3. The relative productivities of the enzymes are listed in Table 11.2.

Example 12

ADP-Glycosyltransferase Variants of SEQ ID NO: 562

In this Example, experiments for evolution and screening of GT polypeptides derived from SEQ ID NO: 562 for improved glucosylation of steviol glycosides using ADP-glucose are described. Directed evolution of the GT encoded by SEQ ID NO:561 (i.e., SEQ ID NO:562) was carried out by constructing libraries in which mutations associated with improved activity in previous rounds were recombined. This library was then plated, grown, and screened using the high-throughput (HTP) assay described below to provide a seventh round ("Round 7") of 37 engineered GT variant polypeptides with glucosyltransferase activity toward ADP-glucose and steviol glycosides (Table 12.1).

HTP Assay for Glucose Transfer from ADP-Glucose to Steviol Glycosides

Assays were performed on 96-well plates of cleared *E. coli* culture lysates expressing SEQ ID NO: 562 variants. Lysis buffer volume was 400 uL, and the lysate was diluted 4-fold. The assay was conducted with 10 µL lysate in 100 µL

TABLE 11.2

Round 6 Variant SFP Activity on Stevioside and Rebaudioside D

| SEQ ID NO: (nt/aa) | Amino Acid Differences (Relative to SEQ ID NO: 548) | Increased RebA[a] | Increased RebM[a] |
|---|---|---|---|
| 576 | I14V/I28M/T54P/D161L/K185R/V413L | +++ | ++ |
| 568 | I28M/I44V/S118A/S156A/D161L/K222R/K289S/V435Q/M438A | +++ | ++ |
| 554 | I28M/R74W/S156A/D161L/V365I/A407E | ++++ | + |
| 562 | I14V/I28M/K38R/R74W/L100F/R102K/S118A/D161L/D169G/A178V/I233W/T250R/A407E/I422M/M438A | ++ | ++ |

[a]Levels of increased activity were measured as fold-change relative to SEQ ID NO: 548 in µmol RebA or RebM/mg SFP-min at 0.0625 g/L SFP and 60 mm and defined as follows: "+" = activity at least that of the reference polypeptide, but less than 2-fold; "++" = at least 2-fold, but less than 3-fold; "+++" = at least 3-fold, but less than 4-fold; and "++++" = at least 4-fold increased activity, as compared to the reference polypeptide.

reactions and with substrate loading of 1 mM stevioside (ChromaDex, >94% purity), from a 20 mM stock solution in 50% ethanol and co-substrate loading of 1 mM ADP-glucose (Sigma, >93% purity). The following reaction conditions were used: 50 mM potassium phosphate buffer, pH 7, 3 mM MgCl$_2$, 50° C. in a Thermotron® titre-plate shaker with 300 RPM shaking for 1 h. The reactions were quenched by adding 10 μl assay 90 μL acetonitrile with 0.2% formic acid and centrifuged 10 m at 4° C. The supernatants were diluted 1:10 in water and analyzed by RapidFire SPE-MS/MS as described in Table 9.3. The top 84 variants were retested with the same conditions using 1 mM stevioside (Chromadex, >94% purity), 1 mM rebaudioside A (>97% purity), or rebaudioside D (Chromadex, >93% purity). The resulting engineered GT variant polypeptides are listed in Table 12.1.

TABLE 12.1

Round 7 Variants and RebA, RebI, and RebM Levels

| SEQ ID NO: (nt/aa) | Amino Acid Differences (Relative to SEQ ID NO: 562) | Increased RebA$^a$ | Increased RebI$^b$ | Increased RebM$^b$ |
|---|---|---|---|---|
| 681/682 | I75L/M87W/A110G/N137G/G169S/S191R/A199K/K208A/Q209G/K289S/V435Q | +++ | − | − |
| 683/684 | M87W/G169S/S191R/A199K/I207L/Q209G/W401L/V413L | +++ | − | − |
| 685/686 | I44V/M87W/N137G/Q159M/G169S/S191R/A199K/K208D | +++ | − | − |
| 687/688 | I44V/M87W/A199K/K208A | +++ | − | − |
| 689/690 | M87W/I92L/Q159M/S191R/A199K/K208A/Q209G/K289S/D290E | +++ | − | − |
| 691/692 | N137G/I198M/A199K/I207L/K208D/A426V/V435R | ++ | ++ | + |
| 693/694 | I75L/S76R/M87W/S191R/Q197R/A199K/Q209G/D300Q | ++ | − | − |
| 695/696 | I75L/S76R/M87W/S191R | ++ | ++ | + |
| 697/698 | V19L/I75L/S76R/M87W/I92L/A199K/I207L/K208A | ++ | − | − |
| 699/700 | N137G/A199K/K208A/Q209G/D290E/V435R | ++ | − | − |
| 701/702 | G169S/Q197R/A199K/I207L/Q209G/K222R/D300Q/V413L/V435R | ++ | − | − |
| 703/704 | G169S/S191R/Q197R/A199K/I207L/K208D | ++ | − | − |
| 705/706 | I75L/A110G/Q197R/A199K/K208A/D290E/D300Q/W401L/V413L | ++ | − | − |
| 707/708 | I92L/N137G/S191R/A199K/Q209G | ++ | − | − |
| 709/710 | M87W/I92L/A110G/G169S/A199K/I207L/Q209G/D290E/D300Q | ++ | − | − |
| 711/712 | S76R/I92L/A199K/Q209G | + | − | − |
| 713/714 | M87W/N137G/V435R | + | ++++ | + |
| 715/716 | I44V/S76R/Q197R/A199K/K208D/A351G | + | − | − |
| 717/718 | I75L/M87W/D300Q | + | +++ | + |
| 719/720 | V19L/I44V/A110G/S191R/I198M/A199K/K208A/D300Q/V365I | + | − | + |
| 721/722 | I44V/M87W/I92L/N137G/Q159M/A199K/Q209G | + | − | − |
| 723/724 | I75L/S76R/M87W/I92L/D290E/D300Q | + | ++ | − |
| 725/726 | M87W/S191R/I198M/A199K/K222R/P244L/K289S/D300Q/V435R | + | − | − |
| 727/728 | M87W/I92L/K208A/W401L | + | + | − |
| 729/730 | Q197R/I198M/A199K/K208D/Q209G | + | − | − |
| 731/732 | M87W/I92L/Q159M/G169S/S191R/I198M/D290E/V413L/V435Q | + | − | − |
| 733/734 | S191R/I207L/K208A/K289S/D290E/V413L/V435Q | + | + | ++ |
| 735/736 | N137G/V365I | + | ++ | + |
| 737/738 | V19L/M87W/I92L/S191R/A199K/Q209G/V413L/V435Q | + | − | − |
| 739/740 | I75L/S76R/M87W/I92L | + | − | − |
| 741/742 | I75L/M87W/I92L/G169S/I207L/K208A/D300Q/V413L/V435Q | + | + | − |
| 743/744 | I44V/M87W/N137G/S191R/Q197R/Q209G/K289S/W401L | + | − | − |
| 745/746 | I92L/Q197R/A199K/I207L/K208D/W401L | + | − | − |
| 747/748 | I75L/M87W/A110G/S191R/Q197R/I198M/I207L/K208D/K289S/D290E/D300Q/W401L/V413L | + | − | − |
| 749/750 | Q159M/Q197R/A199K/I207L/Q209G | + | − | − |
| 751/752 | M87L/I92L/Q197R/I198M/A199K/K208D/D300Q | + | − | − |
| 753/754 | M87W/V435R | + | − | − |

$^a$Levels of increased production were determined relative to the reference polypeptide of SEQ ID NO: 562, and defined as follows: "−" = production less than that of the reference polypeptide; "+" = production at least that of the reference polypeptide, but less than 3-fold; "++" = at least 3-fold, but less than 5-fold; and "+++" = at least 5-fold increased production, as compared to the reference polypeptide.
$^b$Levels of increased production were determined relative to the reference polypeptide of SEQ ID NO: 562, and defined as follows: "−" = production less than that of the reference polypeptide; "+" = production at least that of the reference polypeptide, but less than 1.5-fold; "++" = at least 1.5-fold, but less than 2-fold; "+++" = at least 2-fold, but less than 2.5-fold; and "++++" = at least 2.5-fold increased production, as compared to the reference polypeptide.

Example 13

Synthesis, Optimization, and Assaying of Glycosyltransferase Enzymes with Glucosylation Activity In this Example, methods used in the synthesis, optimization and assaying of UGT enzymes with glucosylation activity are described.

Gene Synthesis and Optimization

Polynucleotide sequences encoding glycosyltransferases from *Oryza sativa Japonica*, *Solanum tuberosum*, *Lycium barbarum*, and *Solanum lycopersicum* were codon-optimized and synthesized as the genes of SEQ ID NOS: 755, 757, 759, 761, 763, 765, and 767. These synthetic genes were cloned into a pCK110900 vector system (See e.g., US Pat. Appln. Publn. No. 2006/0195947, which is hereby incorporated by reference) and subsequently expressed in *E. coli* W3110 (ΔfhuA). The *E. coli* strain W3110 expressed the UGT enzymes under the control of the lac promoter.

Production of Shake Flask Powders (SFP)

A shake-flask procedure was used to generate the glycosyltransferase polypeptide shake flask powders (SFP) for characterization assays used in the biocatalytic processes described herein. Shake flask powder (SFP) preparation of enzymes provides a more purified preparation (e.g., up to >30% of total protein) of the enzyme as compared to the cell lysate used in HTP assays and also allows for the use of more concentrated enzyme solutions. A single colony of *E. coli* containing a plasmid encoding an engineered polypeptide of interest was inoculated into 5 mL Luria Bertani broth containing 30 µg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7.0, 1 mM MgSO$_4$) containing 30 µg/ml CAM, in a 1 L flask to an optical density of 600 nm (OD600) of 0.2 and allowed to grow at 30° C.

Expression of the glycosyltransferase gene was induced by addition of IPTG to a final concentration of 1 mM when the OD600 of the culture was 0.6 to 0.8. Incubation was then continued overnight (at least 16 hours). Cells were harvested by centrifugation (5000 rpm, 15 min, 4° C.) and the supernatant discarded. The cell pellet was resuspended in two volumes of 25 mM triethanolamine buffer, pH 7.5, and passed through a MICROFLUIDIZER® high pressure homogenizer (Microfluidics), with standard *E. coli* lysis settings and maintained at 4° C. Cell debris was removed by centrifugation (10,000 rpm, 45 minutes, 4° C.). The cleared lysate supernatant was collected and frozen at -80° C. and then either His-affinity purified and dialyzed to produce purified protein or lyophilized to produce a dry shake-flask powder of crude protein.

Assay for Rebaudioside A Glucosylation with Purified Proteins

First, 50 µL purified protein was diluted in 200 µL total reaction volume consisting of 50 mM Tris-HCl buffer pH 7.5, 3 mM magnesium chloride, 1 mM rebaudioside A, and 0.5 mM uridine diphosphoglucose. The reaction was performed at 30° C. in a Thermotron® titre-plate shaker with 300 RPM shaking for 18 h. Boiled enzyme reaction was used as the negative control. Ten L of the reaction was quenched with 90 µL acetonitrile with 0.2% formic acid and precipitated by centrifugation. Glycosylated rebaudioside A products were detected in the supernatant by LC-MS/MS as described in Example 1, Table 1.1.

Production of rebaudioside D from rebaudioside A was detected for SEQ ID NO: 756, 758, 762, and 768. Some enzymes also produced a regioisomer of rebaudioside D, likely the 6-linked molecule rebaudioside D2. Despite poor soluble expression, SEQ ID NO: 758 demonstrated high specific activity and good selectivity toward producing β-1,2-glucose linkages in the steviol glycoside substrates.

Assay for Rebaudioside A Glucosylation with Shake Flask Powder

Lyophilized shake flask powder was reconstituted to 20 mg/mL. Then, 10 µL of these stocks were diluted in 100 µL total reaction volume of 50 mM potassium phosphate (KPhos) buffer, pH 7, with 3 mM MgCl$_2$, 1 mM rebaudioside A (>97% purity), and 2 mM uridine diphosphoglucose (UDP-glucose). The reaction was performed at 40° C. in a Thermotron® titre-plate shaker with 300 RPM shaking for 16-18 h. Activity was detected for SEQ ID NO: 758 over negative control. Low conversion (i.e., <10%), of rebaudioside A to rebaudioside D was observed in the LC-MS/MS analysis.

Example 14

GT Variants of SEQ ID NO: 758

In this Example, experiments for evolution and screening of GT polypeptides derived from SEQ ID NO: 758 for improved glucosylation of steviol glycosides are described. Directed evolution of the GT encoded by SEQ ID NO: 757 (i.e., SEQ ID NO: 758) was carried out by constructing combinatorial libraries of variant genes in which positions associated with surface residues of the enzyme were subjected to mutagenesis. These libraries were then plated, grown, and screened using the high-throughput (HTP) assay described below to provide a first round ("Round 1") of 10 engineered GT variant polypeptides with β-1,2-glucosyltransferase activity toward steviol glycosides.

HTP Growth, Expression, and Lysate Preparation

Cells were picked into 96-well plates and grown overnight in LB media containing 1% glucose and 30 µg/mL CAM, 30° C., 200 rpm, 85% humidity. Then, 20 µL of overnight growth were transferred to a deep-well plate containing 380 µL TB growth media containing 30 µg/mL CAM, induced with 1 mM IPTG, and incubated for 18 h at 30° C., 200 rpm, 85% humidity. Cell cultures were centrifuged at 4000 rpm, 4° C. for 10 m, and the media discarded. Cell pellets thus obtained were frozen at -80° C., and lysed in 250 µL lysis buffer (0.5 g/L lysozyme and 0.5 g/L PMBS in 20 mM Tris-HCl buffer, pH 7.5) with low-speed shaking for 2 h on titre-plate shaker at room temperature. The plates were then centrifuged at 4000 rpm and 4° C. for 20 min and the cleared lysate supernatants were used in the HTP assay reactions described below.

HTP Assay for Rebaudioside A Glucosylation

Assays were performed on 96-well plates of cleared *E. coli* culture lysates expressing SEQ ID NO: 757 variants with lysate loading of 25 µL lysate in 100 µL reactions and with substrate loading of 1 mM rebaudioside A (Sigma, >96% purity), from a 20 mM stock solution in 50% ethanol, and co-substrate loading of 0.5 mM UDP-glucose (Sigma, >98% purity). The following reaction conditions were used: 50 mM Tris-HCl buffer, pH 7.5, 3 mM MgCl$_2$, 30° C. in a Thermotron® titre-plate shaker with 300 RPM shaking for 4 h. The reactions were quenched with 0.5 volume/volume acetonitrile with 0.2% formic acid and precipitated by centrifugation for 10 m at 4° C. Glycosylated products were detected in the supernatant by LC-MS/MS following 1:20 dilution in water with the instrument and parameters described in Example 1, Table 1.1. Glycosyltransferase variant polypeptides that produced rebaudioside D from rebaudioside A at greater quantities than SEQ ID NO: 758 were identified. The engineered polypeptides are listed in Table 14.1. Shake-flask scale cultures were grown for lyophilized powder production as described in Example 1 for analysis of variants with the following amino acid mutations shown in Table 14.1, relative to SEQ ID NO: 758.

TABLE 14.1

Round 1 Variants and RebD Levels

| SEQ ID NO: (nt/aa) | Amino Acid Differences (Relative to SEQ ID NO: 758) | Increased RebD[a] |
|---|---|---|
| 769/770 | R69H/Y173N/V243A/M383V/T399A | +++ |
| 771/772 | Y173H/P175S/N191D/M365I/M383V/T399A | +++ |
| 773/774 | I56T/N191D/L354I/M383V/T399A | +++ |
| 775/776 | R69H/Y173N/P175S/V243A/M246K/L354I/M365I/M383V/T399A | +++ |
| 777/778 | F70L/N225G/I413V | ++ |
| 779/780 | F70L/N225G/E247G | ++ |
| 781/782 | F70L/N225G/M246P/E409K/I413V | ++ |
| 783/784 | F70L/Q115S/N225G/E409K | ++ |
| 785/786 | H74T/K310D/G396E/N424S | ++ |
| 787/788 | H74T/G396E | + |

[a]Levels of increased production were determined relative to the reference polypeptide of SEQ ID NO: 4, and defined as follows: "−" = production less than the reference polypeptide; "+" = production at least that of the reference polypeptide, but less than 3-fold; "++" = at least 3-fold, but less than 5-fold; and "+++" = at least 5-fold increased production, as compared to the reference polypeptide.

Shake Flask Lysate Characterization Assay and Analysis for Rebaudioside Glucosylation First, 250 mL shake flask cultures were grown, induced, and lysed. Cell debris was removed by centrifugation as described in Example 1, and the cleared lysate supernatant was collected. Then, 10 μL of the lysate were diluted in 100 μL total reaction volume of 50 mM Tris-HCl buffer, pH 7.5, 3 mM $MgCl_2$, 1 mM rebaudioside A (Sigma, >96% purity), and 2 mM UDP-glucose (Sigma>98% purity). The reaction was performed at 30° C. in a Thermotron® titre-plate shaker with 300 RPM shaking for 0-18 h. The reaction described above was quenched with 0.5 volume/volume acetonitrile with 0.2% formic acid and precipitated by centrifugation. Glycosylated products were detected in the supernatant by LC-MS/MS following 1:20 dilution in water with the instrument and parameters described in Example 1, Table 1.1.

TABLE 14.2

Shake-flask Characterization of Round 1 Variants and RebD Levels

| SEQ ID NO: (nt/aa) | Amino Acid Differences (Relative to SEQ ID NO: 758) | Increased RebD[a] |
|---|---|---|
| 769/770 | R69H/Y173N/V243A/M383V/T399A | + |
| 771/772 | Y173H/P175S/N191D/M365I/M383V/T399A | + |
| 777/778 | F70L/N225G/I413V | − |
| 779/780 | F70L/N225G/E247G | − |
| 785/786 | H74T/K310D/G396E/N424S | − |
| 787/788 | H74T/G396E | − |

[a]Levels of increased production were determined relative to the reference polypeptide of SEQ ID NO: 758, at 4 h and defined as follows: "−" = production less than the reference polypeptide; and "+" = production at least that of the reference polypeptide, but less than 1.5-fold increased production, as compared to the reference polypeptide.

Variants corresponding to SEQ ID NOS:770 and 772 produced rebaudioside D from rebaudioside A at greater quantities than the variant of SEQ ID NO: 758. The variant of SEQ ID NO: 770 exhibited the highest activity on RebA.

Thus, the encoding polynucleotide (SEQ ID NO: 769) was selected for further directed evolution.

Example 15

ADP-Glycosyltransferase Variants of SEQ ID NO: 770

In this Example, experiments for evolution and screening of GT polypeptides derived from the SEQ ID NO: 770 variant for improved glucosylation of steviol glycosides using ADP-glucose are described. Directed evolution of the GT encoded by SEQ ID NO: 769 (i.e., SEQ ID NO: 770) was carried out by constructing libraries of variant genes. Libraries recombined beneficial mutations identified in Example 14 (Round 1), combinatorially incorporated diversity from homologs in publically available databases, or subjected certain structural features of the enzyme with saturation mutagenesis. These libraries were then plated, grown, and screened using the high-throughput (HTP) assay described below to provide a second round ("Round 2") of engineered GT variant polypeptides with glucosyltransferase activity toward ADP-glucose and steviol glycosides. 10 engineered variants were identified from the recombined beneficial mutations (Table 15.1), 19 from saturation mutagenesis (Table 15.2), and 53 from surface residue and homolog diversity (Table 15.3).

HTP Assay for Glucose Transfer from ADP-Glucose to Rebaudioside A

Assays were performed on 96-well plates of cleared *E. coli* culture lysates expressing SEQ ID NO: 769 variants with lysate loading of 25 μL lysate in 100 μL reactions and with substrate loading of 1 mM rebaudioside A (Sigma, >96% purity) and co-substrate loading of 4 mM ADP-glucose (Sigma, >93% purity). The following reaction conditions were used: 50 mM Tris-HCl buffer, pH 7.5, 3 mM $MgCl_2$, 30° C. in a Thermotron® titre-plate shaker with 300 RPM shaking for 18 h. The reactions were quenched with 0.5 volume/volume acetonitrile with 0.2% formic acid and precipitated by centrifugation for 10 m at 4° C. Glycosylated products were detected in the supernatant by LC-MS/MS following 1:10 dilution in water with the instrument and parameters described in Example 1, Table 1.1. Glycosyltransferase variant polypeptides that produced rebaudioside D from rebaudioside A with ADP-glucose, at greater quantities than SEQ ID NO: 770 were identified. The engineered polypeptides from the recombined beneficial mutations are listed in Table 15.1. The engineered polypeptides from the saturation mutagenesis libraries are listed in Table 15.2.

TABLE 15.1

Combinatorial Round 2 AGT Variants and RebD Levels

| SEQ ID NO: (nt/aa) | Amino Acid Differences (Relative to SEQ ID NO: 770) | Increased RebD[a] |
|---|---|---|
| 789/790 | Y24E/S28N/F262Y/C264S | ++++ |
| 791/792 | Y24E/S28N/F262Y/C264S/K423E | +++ |
| 793/794 | S28N/F262Y/C264S | +++ |
| 795/796 | F262Y/C264S | ++ |
| 797/798 | C264S/I291V | + |
| 799/800 | Y24E/C264S/A294V | + |
| 801/802 | S28N | + |
| 803/804 | S28N/K423E | + |

TABLE 15.1-continued

Combinatorial Round 2 AGT Variants and RebD Levels

| SEQ ID NO: (nt/aa) | Amino Acid Differences (Relative to SEQ ID NO: 770) | Increased RebD[a] |
|---|---|---|
| 805/806 | Y24E/S28N/F262Y | + |
| 807/808 | Y24E/S28N | + |

[a]Levels of increased production were determined relative to the reference polypeptide of SEQ ID NO: 770, and defined as follows: "+" = production at least 1.2-fold, but less than 3-fold; "++" = at least 3-fold, but less than 6-fold; "+++" = at least 6-fold, but less than 9-fold; and "++++" = at least 9-fold increased production, as compared to the reference polypeptide.

TABLE 15.2

Saturation Mutagenesis Round 2 Variants and RebD Levels

| SEQ ID NO: (nt/aa) | Amino Acid Differences (Relative to SEQ ID NO: 770) | Increased RebD[a] |
|---|---|---|
| 809/810 | Y24V | ++++ |
| 811/812 | C264A | ++++ |
| 813/814 | Y24L | +++ |
| 815/816 | S28L | ++ |
| 817/818 | Y269S | ++ |
| 819/820 | H366Q | ++ |
| 821/822 | H366T | ++ |
| 823/824 | S28G | + |
| 825/826 | N32C | + |
| 827/828 | K325G | + |
| 829/830 | Y269W | + |
| 831/832 | N32S | + |
| 833/834 | M351L | + |
| 835/836 | H366L | + |
| 837/838 | N32R | + |
| 839/840 | C264G | + |
| 841/842 | K325H | + |
| 843/844 | F341V | + |
| 845/846 | S28K | + |

[a]Levels of increased production were determined relative to the reference polypeptide of SEQ ID NO: 770 and defined as follows: "+" = production that of the reference polypeptide, but less than 2-fold; "++" = at least 2-fold, but less than 3-fold; "+++" = at least 3-fold, but less than 4-fold; and "++++" = at least 4-fold increased production, as compared to the reference polypeptide.

HTP Assay for Glucosylation of Rebaudioside A

The remaining combinatorial round 2 libraries were screened as follows: Assays were performed on 96-well plates of cleared E. coli culture lysates expressing SEQ ID NO: 769 variants with lysate loading of 25 μL lysate in 100 μL reactions or with 10 μL 4-fold diluted lysate in 100 μL reactions with substrate loading of 1 mM rebaudioside A (Sigma, >96% purity) and co-substrate loading of 1 mM UDP-glucose (Sigma, >98% purity). The following reaction conditions were used: 50 mM Tris-HCl buffer, pH 7.5, 3 mM MgCl$_2$, 40° C. in a Thermotron® titre-plate shaker with 300 RPM shaking for 1-2 h. The reactions were either quenched with 0.5 volume/volume acetonitrile with 0.2% formic acid or 10 μL of the reaction was quenched with 90 μL acetonitrile with 0.2% formic acid and precipitated by centrifugation. Glycosylated products were detected in the supernatant by LC-MS/MS following 1:100 or 1:10 dilution in water with the instrument and parameters described in Example 1, Table 1.1. Glycosyltransferase variant polypeptides that produced rebaudioside D from rebaudioside A at greater quantities than SEQ ID NO: 770 were identified. The engineered polypeptides are listed in Table 15.3.

TABLE 15.3

Additional Combinatorial Round 2 Variants and RebD Levels

| SEQ ID NO: (nt/aa) | Amino Acid Differences (Relative to SEQ ID NO: 770) | Increased RebD[a] |
|---|---|---|
| 847/848 | I56T/F70L/N191D/M246K/L354I/M365I | +++ |
| 849/850 | H69Q/F70L/N191D/M246K/L354I/M365I | +++ |
| 851/852 | P175S/M246K/L354I | +++ |
| 853/854 | P175S | +++ |
| 855/856 | I56T/F70L/P175S/M246K/L354I | ++ |
| 857/858 | I56T/H69Q/P175S/N191D/M246K/L354I | ++ |
| 859/860 | I56T/F70L/P175S/N191D/L354I/M365I | ++ |
| 861/862 | I56T/F70L/N191D/L354I | ++ |
| 863/864 | P175S/N191D | ++ |
| 865/866 | P175S/L354I | ++ |
| 867/868 | I56T/H69Q/F70L/M246K/L354I | ++ |
| 869/870 | F70L/N191D/M246K/L354I/M365I | ++ |
| 871/872 | I56T/H69Q/F70L/P175S/L354I | ++ |
| 873/874 | P175S/M246K/L354I/M365I | ++ |
| 875/876 | P175S/N191D/M246K/L354I/M365I | ++ |
| 877/878 | H69Q/P175S/N191D/M246K/L354I | ++ |
| 879/880 | P175S/N191D/L354I | ++ |
| 881/882 | F70L/P175S/N191D/M246K/L354I/M365I | ++ |
| 883/884 | H69Q/F70L/L354I/M365I | ++ |
| 885/886 | I56T/H69Q/M246K/L354I | ++ |
| 887/888 | H69Q/P175S/L354I | + |
| 889/890 | I56T/H69Q/F70L/N191D/M246K/L354I/M365I | + |
| 891/892 | I56T/H69Q/F70L/P175S/N191D/M246K/L354I | + |
| 893/894 | I56T/P175S/M246K | + |
| 895/896 | I56T/P175S/L354I/M365I | + |
| 897/898 | I56T/H69Q/P175S/M246K/L354I | + |
| 899/900 | I56T/N191D/M246K/L354I | + |
| 901/902 | L354I/M365I | + |
| 903/904 | M246K/L354I | + |
| 905/906 | I56T/P175S/L354I | + |
| 907/908 | I56T/F70L/P175S/M246K/M365I | + |
| 909/910 | I56T/M246K | + |
| 911/912 | I56T/H69Q/M246K/M365I | + |
| 913/914 | I126F/C220L | + |
| 915/916 | I56T/H69Q/P175S/M246K/L354I/M365I | + |
| 917/918 | I126F/K403R | + |
| 919/920 | I56T/M246K/L354I/M365I | + |
| 921/922 | I56T/L354I | + |
| 923/924 | F70L/N191D/M246K/M365I | + |
| 925/926 | H69Q/L354I | + |
| 927/928 | I56T/H69Q/F70L/P175S/N191D/M246K | + |
| 929/930 | H69Q/M246K/L354I/M365I | + |
| 931/932 | I126F | + |
| 933/934 | H69Q | + |
| 935/936 | H69Q/F70L/P175S/N191D/M246K/L354I/M365I | + |
| 937/938 | P175S/N191D/L354I/M365I | + |
| 939/940 | F70L | + |
| 941/942 | N191D/M246K/L354I | + |
| 943/944 | F70L/P175S/N191D/L354I/M365I | + |
| 945/946 | I56T/F70L/P175S/N191D/M246K/L354I | + |
| 947/948 | H69Q/F70L/M246K | + |
| 949/950 | L354I | + |
| 951/952 | I56T/F70L/P175S/N191D/M246K | + |

[a]Levels of increased production were determined relative to the reference polypeptide of SEQ ID NO: 770, and defined as follows: "+" = production at least 1.5-fold, but less than 3-fold; "++" = at least 3-fold, but less than 4.5-fold; and "+++" = at least 4.5-fold increased production, as compared to the reference polypeptide.

HTP Assay for Glucosylation of Rebaudioside I 88 variants from the round 2 saturation mutagenesis library were screened as follows: Assays were performed on 96-well plates of cleared E. coli culture lysates expressing SEQ ID NO: 769 variants with lysate loading of 25 μL lysate in 100 μL reactions with substrate loading of 1 mM rebaudioside I (prepared from rebaudioside A as described in example 10) and co-substrate loading of 1 mM UDP-glucose (Sigma, >98% purity). The following reaction conditions were used: 50 mM potassium phosphate buffer, pH 7, 3 mM MgCl$_2$, 40° C. in a Thermotron® titre-plate shaker with 300 RPM shaking for 66 h. The reactions were quenched by adding 10 μL of the reaction to 90 μL acetonitrile with 0.2% formic acid and precipitated by centrifugation. Glycosylated products were detected in the supernatant by LC-MS/MS following 1:10 dilution in water with the instrument and parameters described in Table 15.5. Glycosyltransferase variant polypeptides that produced rebaudioside M from rebaudioside I at greater quantities than SEQ ID NO: 770 were identified. The top two engineered polypeptides are SEQ ID NO: 1292 and 1294, which have mutations F156R and G199H, respectively, relative to SEQ ID NO: 770.

Shake-flask scale cultures were grown for SFP production as described in Example 1 for analysis of variants with the amino acid mutations shown in Table 15.4 (relative to SEQ ID NO: 770).

SFP Characterization Assay and Analysis for Glucosyl Transfer from ADP-Glucose to Rebaudioside A Shake flask powders were reconstituted to provide 20 g/L powder. Then, 10 µL of these stocks were diluted in 100 µL total reaction volume of 50 mM Tris-HCl buffer, pH 7.5, with 3 mM MgCl$_2$, 1 mM rebaudioside A (Sigma, >96% purity), and 4 mM ADP-glucose (Sigma, >93% purity). The reaction was performed at 30° C. in a Thermotron® titre-plate shaker with 300 RPM shaking for 0-19 h. The reaction was quenched and precipitated as described in Example 14. Glycosylated products were detected in the supernatant by LC-MS/MS following 1:100 dilution in water with the instrument and parameters described in Example 1, Table 1.1.

TABLE 15.4

Shake Flask Powder Characterization of Round 2 Variants and RebD Levels

| SEQ ID NO: (nt/aa) | Amino Acid Differences (Relative to SEQ ID NO: 770) | Increased RebD[a] |
|---|---|---|
| 789/790 | Y24E/S28N/F262Y/C264S | +++ |
| 791/792 | Y24E/S28N/F262Y/C264S/K423E | +++ |
| 793/794 | S28N/F262Y/C264S | ++ |
| 795/796 | F262Y/C264S | ++ |

[a]Levels of increased production were determined relative to the reference polypeptide of SEQ ID NO:770, at 0.5 h and defined as follows:
"–" = production less than the reference polypeptide;
"+" = production at least that of the reference polypeptide, but less than 5-fold;
"++" = at least 5-fold, but less than 10-fold; and
"+++" = at least 10-fold increased production, as compared to the reference polypeptide.

All variants in Table 15.4 (i.e., variants of SEQ ID NOS: 790, 792, 794, and 796) produced rebaudioside D from rebaudioside A with ADP-glucose, at greater quantities than SEQ ID NO: 770. Thus, these engineered ADP-glycosyltransferase enzymes provide new biocatalytic reagents for the β-glucosylation of rebaudioside A to rebaudioside D. In these experiments, the variant of SEQ ID NO: 792, had the highest initial activity on rebaudioside A with ADP-glucose as a co-substrate. Thus, the encoding polynucleotide (SEQ ID NO: 791) was selected for further directed evolution.

TABLE 15.5

HPLC-MS/MS Analysis of Steviol Glycosides

| Instrument | Agilent HPLC 1200 series, Sciex 4000 QTrap |
|---|---|
| Column | Poroshell 120 EC C18 50 × 3.0 mm, 2.7 µm with Poroshell 120 EC C18 5 × 3.0, 2.7 µm guard column (Agilent Technologies) |
| Mobile phase | Gradient (A: 0.1% formic acid in water, B: 0.1% formic acid in methanol) |

| Time (m) | % B |
|---|---|
| 0 | 40 |
| 0.50 | 53 |
| 5.00 | 53 |

TABLE 15.5-continued

HPLC-MS/MS Analysis of Steviol Glycosides

| | |
|---|---|
| 5.50 | 70 |
| 7.50 | 70 |
| 8.00 | 95 |
| 8.50 | 95 |
| 8.51 | 60 |
| 9.20 | 40 |

| | |
|---|---|
| Flow rate | 0.8 mL/m |
| Run time | 9.2 m |
| Peak retention times | Rebaudioside M: 4.37 m |
| | Rebaudioside I: 6.70 m |
| | Other glucosylated rebaudioside I product: 4.8 m |
| | Second glucosylated rebaudioside I product: 6.7 m |
| Column temperature | 40° C. |
| Injection volume | 10 µL |
| MS detection | MRM 990/828 (for steviol tetraglycosides, e.g., rebaudioside A), 1152/828 (for steviol pentaglycosides, e.g., rebaudioside D), 1314/828 (steviol hexaglycosides, e.g., rebaudioside M), 828/666 (for steviol triglycosides, e.g., stevioside), 666/504 (steviol diglycosides, e.g., rubusoside) |
| MS conditions | MODE: MRM; CUR: 30; IS: 4750; CAD: high; TEM: 550° C.; GS1: 50; GS2: 50; DP: 150; EP: 10; CXP: 14; DT: 50 ms for each transition. For the first three transitions CE: 85; for the last two transitions CE: 60. |

Example 16

ADP-Glycosyltransferase Variants of SEQ ID NO: 792

In this Example, experiments for evolution and screening of GT polypeptides derived from SEQ ID NO: 792 for improved glucosylation of steviol glycosides using ADP-glucose are described. Directed evolution of the GT encoded by SEQ ID NO: 791 (i.e., SEQ ID NO: 792) was carried out by constructing libraries of variant genes in which mutations associated with improved activity in previous rounds above were recombined. These libraries were then plated, grown, and screened using the high-throughput (HTP) assay described below to provide a third round ("Round 3") of engineered GT variant polypeptides with glucosyltransferase activity toward ADP-glucose and steviol glycosides.

HTP Assay for Glucose Transfer from ADP-Glucose to Rebaudioside A

Assays were performed on 96-well plates of cleared E. coli culture lysates expressing SEQ ID NO: 792 variants with lysate loading of 25 µL lysate in 100 µL reactions and with substrate loading of 1 mM rebaudioside A (>97% purity) and co-substrate loading of 1 mM ADP-glucose (Sigma, >93% purity). The following reaction conditions were used: 50 mM KPhos buffer, pH 7, 3 mM MgCl$_2$, 40° C. in a Thermotron® titre-plate shaker with 300 RPM shaking for 5-6 h. Then, 10 µL of the reactions were quenched with 90 µL acetonitrile with 0.2% formic acid, centrifuged 10 m at 4° C., and, the supernatants were analyzed by RapidFire-MS/MS as described in Example 9, Table 9.3. Glycosyltransferase variant polypeptides that produced rebaudioside D from rebaudioside A with ADP-glucose, at greater quantities than SEQ ID NO: 792 were identified. The engineered polypeptides are listed in Table 16.1. Shake-flask scale cultures were grown for SFP production as described in Example 1 for analysis of variants shown in Table 16.1 relative to SEQ ID NO: 792.

TABLE 16.1

Round 3 Variants and RebD Levels

| SEQ ID NO: (nt/aa) | Amino Acid Differences (Relative to SEQ ID NO: 792) | Increased RebD[a] |
|---|---|---|
| 953/954 | F70L/I126F/N191D/M246K/K325H/M351L/L354I/H366Q/E423K | ++++ |
| 955/956 | F70L/I126F/N191D/M246K/K325H/M351L/H366Q/E423K | ++++ |
| 957/958 | F70L/I126F/N191D/M246K/L354I/H366Q | +++ |
| 959/960 | F70L/I126F/P175S/N191D/M246K/K325H/L354I/H366Q | +++ |
| 961/962 | F70L/I126F/M246K/L354I/H366Q | +++ |
| 963/964 | F70L/I126F/N191D/M246K/K325H/M351L/L354I/E423K | +++ |
| 965/966 | F70L/I126F/M246K/P330Q/H366Q | +++ |
| 967/968 | F70L/I126F/P175S/K325H/P330Q/M351L/L354I/H366Q | +++ |
| 969/970 | E24L/N32S/Y269S/A382G/I385V/D389E/L402I/I406M | ++ |
| 971/972 | E24L/N32S/P330Q | ++ |
| 973/974 | E24L/N32S/S264A/Y269S/P330Q/L402V/K403R | ++ |
| 975/976 | E24L/N32S/S264A/P330Q | ++ |
| 977/978 | I126F/T211E/T260V/E423K | ++ |
| 979/980 | I126F/C220L/T260V | ++ |
| 981/982 | E24L/N32S/Y269S/K403R | ++ |
| 983/984 | E24L/N32S/Y269S | ++ |
| 985/986 | I126F/C220L/I316V | ++ |
| 987/988 | E24L/N32S/S264A/Y269S/A382G/K403R/I406M | ++ |
| 989/990 | C220L/T260V/E423K | ++ |
| 991/992 | I126F/T211E/C220L/G253D/I316V/I342L | ++ |
| 993/994 | I126F/T211E/C220L/D275Q/V279L/L323V | ++ |
| 995/996 | C220L/T260V | + |
| 997/998 | I56V/C220L/T260V/E423K | + |
| 999/1000 | E24L/S264A/Y269S/D389E/L402V/I406M | + |

[a]Levels of increased production were determined relative to the reference polypeptide of SEQ ID NO: 792, and defined as follows:
"+" = production at least 1.4-fold that of the reference polypeptide, but less than 2.8-fold;
"++" = at least 2.8-fold, but less than 4.2-fold;
"+++" = at least 4.2-fold, but less than 5.6-fold; and
"++++" = at least 5.6-fold increased production, as compared to the reference polypeptide.

SFP Characterization Assay and Analysis for Glucosyl Transfer from ADP-Glucose to Rebaudioside A Shake flask powders were reconstituted to provide 20 g/L powder. Then, 10 μL of these stocks were diluted in 100 μL total reaction volume of 50 mM KPhos buffer, pH7, with 3 mM $MgCl_2$, 1 mM rebaudioside A (>97% purity), and 2 mM ADP-glucose (Sigma, >93% purity).

The reaction was performed at 40° C. in a Thermotron® titre-plate shaker with 300 RPM shaking for 0-21 h. The reaction was quenched and precipitated as described above. Glycosylated products were detected in the supernatant by LC-MS/MS following 1:10 dilution in water with the instrument and parameters described in Example 1, Table 1.1.

TABLE 16.2

Shake Flask Powder Characterization of Round 3 Variants and RebD Levels

| SEQ ID NO: (nt/aa) | Amino Acid Differences (Relative to SEQ ID NO: 792) | Increased RebD[a] |
|---|---|---|
| 953/954 | F70L/I126F/N191D/M246K/K325H/M351L/L354I/H366Q/E423K | +++ |
| 955/956 | F70L/I126F/N191D/M246K/K325H/M351L/H366Q/E423K | ++ |
| 989/990 | C220L/T260V/E423K | +++ |

[a]Levels of increased production were determined relative to the reference polypeptide of SEQ ID NO: 792, at 2 h and defined as follows:
"+" = production at least that of the reference polypeptide, but less than 2-fold;
"++" = production at least 2-fold, but less than 3-fold; and
"+++" = at least 3-fold increased production, as compared to the reference polypeptide.

In these experiments, all of the variants in Table 16.2 (i.e., SEQ ID NOS: 954, 956, and 990) produced rebaudioside D from rebaudioside A with ADP-glucose, at greater quantities than SEQ ID NO: 792. The variant of SEQ ID NO:954 had the highest activity on rebaudioside A with ADP-glucose as a co-substrate in these experiments. Thus, the encoding polynucleotide (SEQ ID NO: 953) was selected for further directed evolution.

Example 17

ADP-Glycosyltransferase Variants of SEQ ID NO: 954 for Steviol Glycoside Glucosylation, Including Glucosylation of Rebaudioside I to Rebaudioside M In this Example, experiments for evolution and screening of GT polypeptides derived from SEQ ID NO: 954 for improved glucosylation of steviol glycosides using ADP-glucose are described. Directed evolution of the GT encoded by SEQ ID NO: 953 (i.e., SEQ ID NO: 954) was carried out by constructing libraries of variant genes in which mutations associated with improved activity in previous rounds above were recombined. These libraries were then plated, grown, and screened using the high-throughput (HTP) assay described below to provide a fourth round ("Round 4") of engineered GT variant polypeptides with glucosyltransferase activity toward ADP-glucose and steviol glycosides. duction as described in Example 1 for analysis of variants with the following amino acid mutations shown in Table 17.1 (relative to SEQ ID NO: 150).

TABLE 17.1

Round 4 Variants and RebD Levels

| SEQ ID NO: (nt/aa) | Amino Acid Differences (Relative to SEQ ID NO: 954) | Increased RebD[a] |
|---|---|---|
| 1001/1002 | P175S/T211E/S264A/V279L/I316V/L323V | ++++ |
| 1003/1004 | T211E/I385V/D389E | ++++ |
| 1005/1006 | I56V/T211E/S264A/I316V/D389E | +++ |
| 1007/1008 | I56V/P175S/A197P/G253D/I385V/D389E | +++ |
| 1009/1010 | A197P/T211E/L402I | +++ |
| 1011/1012 | T211E/L4021/K403R | +++ |
| 1013/1014 | P175S/T211E/V279L/L323V/P330Q/L402I/K403R/I406M | ++ |
| 1015/1016 | P175S/A197P/T211E/S264A/P330Q | ++ |
| 1017/1018 | P175S/T211E/L323V/A382G/L402I/K403R/I406M | ++ |
| 1019/1020 | P175S/T211E/K403R/I406M | ++ |
| 1021/1022 | I56V/P175S/A197P/T211E/P330Q/A382G/I385V | + |
| 1023/1024 | P175S/S264A/L323V/P330Q | + |
| 1025/1026 | A197P/V279L/L323V | + |
| 1027/1028 | N162R/C220L/W226V/N367W | + |
| 1029/1030 | I56V/S264A/I385V/D389E | + |
| 1031/1032 | E24L/N32S/F126A/E198P/M201G/N367W | + |
| 1033/1034 | I56V/T211E/V279L/L323V/P330Q/L402I | + |
| 1035/1036 | N32S/H97G/E198P/Q202G/W226V/T260V | + |
| 1037/1038 | E24L/N32S/E198P/M201G/W226V | + |
| 1039/1040 | I56V/P175S/S264A/A382G/I385V/D389E/L402V/I406M | + |
| 1041/1042 | E198P/M201G/N367W | + |
| 1043/1044 | E24L/N32S/L146A/V/V226V | + |
| 1045/1046 | D389E | + |
| 1047/1048 | M201G/Q202G/N367W | + |
| 1049/1050 | T211E/A382G/I406M | + |
| 1051/1052 | E24L/N32S/E198P/M201G/C220L/W226V | + |
| 1053/1054 | H97G/Q202G/N367W | + |
| 1055/1056 | E24L/H97G/T260V/N367W | + |
| 1057/1058 | P175S/S264A/I316V/L323V/P330Q/K403R/I406M | + |
| 1059/1060 | A197P/T211E/I316V/I342L/I406M | + |
| 1061/1062 | N32S/Q202G/N367W | + |
| 1063/1064 | A197P/T211E/I316V/A382G/D389E/L402I/K403R | + |
| 1065/1066 | N32S/W226V/N367W | + |
| 1067/1068 | I56V/T211E/G253D/I316V/L323V | + |
| 1069/1070 | E24L/N32S/F126A/E198P/Q202G/C220L/W226V/T260V/Y269S | + |
| 1071/1072 | E198P/Q202G/C220L/Y269S/N367W | + |
| 1073/1074 | P175S/S264A/I316V/D389E/L402V/ | + |
| 1075/1076 | E24L/N32S/H97G/N162R/Q202G | + |
| 1077/1078 | I56V/A197P/S264A/V279L/P330Q/A382G/D389E/L402V/K403R/I406M | + |

[a]Levels of increased production were determined relative to the reference polypeptide of SEQ ID NO: 954, and defined as follows:
"+" = production at least 1.3-fold, but less than 2.6-fold;
"++" = at least 2.6-fold, but less than 3.9-fold;
"+++" = at least 3.9-fold, but less than 5.2-fold; and
"++++" = at least 5.2-fold increased production, as compared to the reference polypeptide.

HTP Assay for Glucose Transfer from ADP-Glucose to Rebaudioside A

Cells were lysed with 400 µL lysis buffer as described in Example 13. Assays were performed on 96-well plates of cleared E. coli culture lysates expressing SEQ ID NO: 954 variants with lysate loading of 20 µL lysate in 100 µL reactions and with substrate loading of 1 mM rebaudioside A (>97% purity) and co-substrate loading of 1 mM ADP-glucose (Sigma, >93% purity). The following reaction conditions were used: 50 mM KPhos buffer, pH 7, 3 mM MgCl$_2$, 40° C. in a Thermotron® titre-plate shaker with 300 RPM shaking for 4h. The reactions were quenched as described in Example 16, and the supernatants were analyzed by RapidFire-MS/MS as described in Example 9, Table 9.3. Glycosyltransferase variant polypeptides that produced rebaudioside D from rebaudioside A with ADP-glucose, at greater quantities than SEQ ID NO: 954 were identified. The engineered polypeptides are listed in Table 17.1. Shake-flask scale cultures were grown for SFP pro- SFP Characterization Assay and Analysis for Glucosyl Transfer from ADP-Glucose to Rebaudioside A Shake flask powders were reconstituted to provide 50 g/L powder. Then, 1 µL of these stocks were diluted in 100 µL total reaction volume of 50 mM KPhos buffer, pH7, with 3 mM MgCl$_2$, 1 mM rebaudioside A (>97% purity), and 2 mM ADP-glucose (Sigma, >93% purity). The reaction was performed at 40° C. in a Thermotron® titre-plate shaker with 300 RPM shaking for 2h. The reaction was then diluted 1:5 in water, and 25 µL of the diluted reaction was quenched with 75L acetonitrile with 0.2% formic acid and precipitated by centrifugation. Glycosylated products were detected in the supernatant by RapidFire-MS/MS following 1:10 dilution in water with the instrument and parameters described in Example 9, Table 9.3.

TABLE 17.2

Shake Flask Characterization of Round 4 Variants and RebD Levels

| SEQ ID NO: (nt/aa) | Amino Acid Differences (Relative to SEQ ID NO: 954) | Increased RebD[a] |
|---|---|---|
| 1053/1054 | H97G;Q202G/N367W | +++ |
| 1031/1032 | E24L/N32S/F126A/E198P/M201G/N367W | +++ |
| 1027/1028 | N162R/C220L/W226V/N367W | ++ |
| 1051/1052 | E24L/N32S/E198P/M201G/C220L/W226V | ++ |
| 1057/1058 | P175S/S264A/I316V/L323V/P330Q/K403R/I406M | ++ |
| 1013/1014 | P175S/T211E/V279L/L323V/P330Q/L402I/K403R/I406M | + |
| 1001/1002 | P175S/T211E/S264A/V279L/I316V/L323V | + |
| 1029/1030 | I56V/S264A/I385V/D389E | – |

[a]Levels of increased production were determined relative to the reference polypeptide of SEQ ID NO: 954, and defined as follows:
"–" = production less than that of the reference polypeptide;
"+" = production at least that of the reference polypeptide, but less than 1.5-fold;
"++" = at least 1.5-fold, but less than 2-fold; and
"+++" = at least 2-fold increased production, as compared to the reference polypeptide.

With the exception of SEQ ID NO: 1030, all other variants in Table 17.2 (SEQ ID NOS: 1054, 1032, 1028, 1052, 1058, 1014, and 1002) produced rebaudioside D from rebaudioside A with ADP-glucose, at greater quantities than SEQ ID NO: 954, in these experiments. The variant with mutations H97G, Q202G, and N367W (SEQ ID NO: 1054), relative to SEQ ID NO: 954, had the highest activity on rebaudioside A with ADP-glucose as a co-substrate in these experiments. Thus, the encoding polynucleotide (SEQ ID NO: 1053) was selected for further directed evolution.

SFP Characterization Assay and Analysis for Glucosyl Transfer from UDP-Glucose to Rebaudioside I Shake flask powders were reconstituted to provide 50 g/L powder. Then, 2 L of these stocks were diluted in 100 µL total reaction volume of 50 mM KPhos buffer, pH 7, with 3 mM MgCl$_2$, 1 mM rebaudioside A (>97% purity), and 2 mM UDP-glucose (Sigma, >98% purity). The reaction was performed at 40° C. in a Thermotron® titre-plate shaker with 300 RPM shaking for 20 h. The reaction was then quenched with 0.5 volume/volume acetonitrile with 0.2% formic acid and precipitated by centrifugation. Glycosylated products were detected in the supernatant by LC-MS/MS following 1:20 dilution in water with the instrument and parameters described in Example 15, Table 15.5.

TABLE 17.3

Shake Flask Characterization of Round 4 Variants and RebM Levels

| SEQ ID NO: (nt/aa) | Amino Acid Differences (Relative to SEQ ID NO: 954) | Increased RebM[a] |
|---|---|---|
| 1001/1002 | P175S/T211E/S264A/V279L/I316V/L323V | ++ |
| 1013/1032 | E24L/N32S/F126A/E198P/M201G/N367W | + |
| 1057/1058 | P175S/S264A/I316V/L323V/P330Q/K403R/I406M | + |
| 1013/1014 | P175S/T211E/V279L/L323V/P330Q/L402I/K403R/I406M | – |
| 1020/1030 | I56V/S264A/I385V/D389E | – |
| 1051/1052 | E24L/N32S/E198P/M201G/C220L/W226V | – |
| 1053/1054 | H97G/Q202G/N367W | – |
| 1027/1028 | N162R/C220L/W226V/N367W | – |

[a]Levels of increased production were determined relative to the reference polypeptide of SEQ ID NO: 954, and defined as follows:
"–" = production less than that of the reference polypeptide;
"+" = production at least that of the reference polypeptide, but less than 1.2-fold; and
"++" = at least 1.2-fold increased production, as compared to the reference polypeptide.

SEQ ID NO: 954 and all variants in Table 17.3 (SEQ ID NOS: 1054, 1032, 1028, 1052, 1014, 1002, and 1030) produced rebaudioside M from rebaudioside I with UDP-glucose, at levels above the negative control. SEQ ID NOS: 1002, 1032, and 1058 produced rebaudioside M from rebaudioside I at levels equal to or above SEQ ID: 954 levels with UDP-glucose. The variant with mutations P175S, T211E, S264A, V279L, I316V, and L323V (SEQ ID NO: 1002), relative to SEQ ID NO: 954, had the highest activity on rebaudioside I with UDP-glucose as a co-substrate. Thus, the encoding polynucleotide (SEQ ID NO: 1001) was selected for further directed evolution for the transformation of rebaudioside I to rebaudioside M.

Example 18

Sucrose Synthase Variants of SEQ ID NO: 74

In this Example, experiments for the evolution and screening of sucrose synthase (SuS) polypeptides derived from SEQ ID NO: 73 for improved production of ADP-glucose from sucrose and ADP are described. Directed evolution of the SuS encoded by SEQ ID NO: 73 (i.e., SEQ ID NO: 74) was carried out by constructing libraries of variant genes in which positions associated with certain structural features of the enzyme were subjected to saturation mutagenesis and diversity from homologs in publically available databases was recombined. These libraries were then plated, grown, and screened using the high-throughput (HTP) assay described below to provide a first round ("Round 1") of 37 engineered SuS variant polypeptides with improved activity toward synthesizing ADP-glucose.

HTP Assay for Glucose Transfer from Sucrose to ADP

Assays were performed on 96-well plates of cleared E. coli culture lysates expressing SEQ ID NO: 73 variants with lysate loading of 25 µL lysate in 100 µL reactions and with substrate loading of 30% w/v sucrose (Sigma) from a 60% stock solution in water and co-substrate loading of 2 mM ADP (Sigma, >95%). The following reaction conditions were used: 50 mM Tris-HCl buffer, pH 7.5, 3 mM MgCl$_2$, 30° C. in a Thermocycler for 2 h. The reactions were heat quenched at 95° C. for 10 minutes, and then analyzed by a colorimetric D-fructose dehydrogenase assay adapted from the literature (See e.g., Ameyama et al., J. Bacteriol., 145: 814-823 [1981]; and Ameyama, Meth. Enzymol., 89:20-29 [1982]). Briefly, an overnight enzyme-coupled assay was conducted in 96-well plates with 20 µL sample, diluted such that fructose concentration is <1 g/L, 20 µL 100 mM potassium ferricyanide (Sigma P-8131), and 160 µL 0.8 units/mL fructose dehydrogenase (Sigma F4892) dissolved in pH 4.6 McIlvaine buffer with 0.1% Triton X-100. This reaction quantitatively converts fructose to $K_4Fe(CN)_6$, which is then quantified colorimetrically by adding 67 µL of the overnight reaction to 33 µL of stop solution (0.3% w/v sodium dodecyl sulfate, Sigma L-4509, 8.1% v/v phosphoric acid, Sigma P-6560, and 0.5% w/v ferric sulfate, Sigma F-1135) and shaking for 20 minutes to allow for complete conversion of $K_4Fe(CN)_6$ to Prussian blue, the absorbance of which is read on a plate reader at a wavelength of 690 nm.

Following the primary assay, 84 engineered sucrose synthase (SuS) variant polypeptides with higher fructose, and therefore higher stoichiometric ADP-glucose, formation activity than SEQ ID NO: 74 were screened in triplicate at a lower substrate load of 2% w/v sucrose (Sigma) and co-substrate load of 1 mM ADP (Sigma, >95%). The engineered polypeptides are listed in Table 18.1.

TABLE 18.1

Round 1 SuS Variants and Fructose Levels

| SEQ ID NO: (nt/aa) | Amino Acid Differences (Relative to SEQ ID NO:74) | Increased Fructose[a] |
|---|---|---|
| 1079/1080 | A4E/Y33Q/L47H/A52D/V343H/F532S | +++ |
| 1081/1082 | A4E/L47H/A52D/F532S | +++ |
| 1083/1084 | A4E/I113Q/F532S | ++ |
| 1085/1086 | V343S/F532S | ++ |
| 1087/1088 | R615L/A789D | ++ |
| 1089/1090 | Q7T | ++ |
| 1091/1092 | R722Y | ++ |
| 1093/1094 | R615E | ++ |
| 1095/1096 | A4E/L9T/Q349H/F532S | ++ |
| 1097/1098 | A4E/V343H | ++ |
| 1099/1100 | A4E/P13R/I113Q | ++ |
| 1101/1102 | R221H | ++ |
| 1103/1104 | A4E/P13R/I113Q/V343H/F532S | + |
| 1105/1106 | A4E/P13R/F532S | + |
| 1107/1108 | R44K | + |
| 1109/1110 | A4E/P13R/I113Q/F532S | + |
| 1111/1112 | A4E/Y33Q/I113Q | + |
| 1113/1114 | V695L | + |
| 1115/1116 | Q8M | + |
| 1117/1118 | G117D/R440T | + |
| 1119/1120 | R440T | + |
| 1121/1122 | H788E | + |
| 1123/1124 | R478T | + |
| 1125/1126 | R611V | + |
| 1127/1128 | R615T | + |
| 1129/1130 | Q95S | + |
| 1131/1132 | F532R | + |
| 1133/1134 | Q444K | + |
| 1135/1136 | R440P | + |
| 1137/1138 | R478V | + |
| 1139/1140 | R615C | + |
| 1141/1142 | F532T | + |
| 1143/1144 | Q444T | + |
| 1145/1146 | R136S | + |
| 1147/1148 | R583Q | + |
| 1149/1150 | R615V | + |
| 1151/1152 | R221A | + |

[a]Levels of increased production were determined relative to the reference polypeptide of SEQ ID NO: 74, and defined as follows:
"+" = production at least that of the reference polypeptide, but less than 1.5-fold;
"++" = at least 1.5-fold, but less than 2.5-fold; and
"+++" = at least 2.5-fold increased production, as compared to the reference polypeptide.

Example 19

Sucrose Synthase Variants of SEQ ID NO: 1080

Directed evolution of the SuS encoded by SEQ ID NO:1079 (i.e., SEQ ID NO:1080) was continued by constructing libraries of variant genes in which mutations associated with improved activity above were recombined and libraries in which additional homolog diversity was recombined. These libraries were then plated, grown, and screened using the high-throughput (HTP) assay described in Example 18, with the lower substrate load, to provide a second round ("Round 2") of 34 engineered SuS variant polypeptides with activity towards the generation of ADP-glucose.

Following primary screening, 42 variants were retested in duplicate and 56 variants were retested in triplicate under the same conditions with the following modifications: 50 mM Tris-HCl pH 7.5 was changed to 50 mM potassium phosphate buffer, pH 7 and the temperature was increased to 50'C. The fructose dehydrogenase assay described in Example 18, was used to quantify fructose production as a proxy for stoichiometric ADP-glucose. The resulting engineered polypeptides are listed in Table 19.1. Shake-flask scale cultures were grown for protein characterization as described in Example 1 for variants with the amino acid mutations shown in Table 19.1 (relative to SEQ ID NO: 1080).

TABLE 19.1

Round 2 SuS Variants and Fructose Levels

| SEQ ID NO: (nt/aa) | Amino Acid Differences (Relative to SEQ ID NO: 1080) | Increased Fructose[a] |
|---|---|---|
| 1153/1154 | R136S/R440P/Q444T/R478T/G603S | ++ |
| 1155/1156 | V68A/R129E/S248A/I595V/V6001I/I756V | ++ |
| 1157/1158 | I113L/A225E/R266N/R415K | ++ |
| 1159/1160 | V68A/R129E/S248A | ++ |
| 1161/1162 | M75V/A105E/R154H/I215F/I264V/A345T | ++ |
| 1163/1164 | A225E/I372V/E534H | ++ |
| 1165/1166 | R85V/I170L/A225E/R266N/E534H | ++ |
| 1167/1168 | Q95S/Q444T/R478V/G603S/M792S | ++ |
| 1169/1170 | H47L/R221H | ++ |
| 1171/1172 | I87E/T125E/N230D/I267V/W375Y/I464F/T708A | ++ |
| 1173/1174 | R440P/Q444T/R583Q/K724H/H788E | + |
| 1175/1176 | Q95S/R478T/K724H | + |
| 1177/1178 | R266N | + |
| 1179/1180 | R136S/R440T/Q444T/R478V/R583Q/H788E | + |
| 1181/1182 | R440T/R478V | + |
| 1183/1184 | R306L/P358E/N703Y/Q776E | + |
| 1185/1186 | R136S/Q444T/R478V/R583Q/H788E/M792S | + |
| 1187/1188 | L98V/S250D | + |
| 1189/1190 | Q95S/R440T/R478V/K724H/H788E/M792S | + |
| 1191/1192 | Q95S/Q201E/R478V/R583Q/K724H/H788E | + |
| 1193/1194 | R93V/D477K/A635S | + |
| 1195/1196 | M75V/A105E/A345T/T410S/Q769R | + |
| 1197/1198 | M75V/A105E/P530L | + |
| 1199/1200 | M75V/A345T/P530L | + |
| 1201/1202 | Q8M/R221H | + |
| 1203/1204 | V466I | + |
| 1205/1206 | Q95S/R136S/H788E | + |
| 1207/1208 | P358E/L636Q/V737I | + |
| 1209/1210 | R93V/R129E/S506P/R550H/I595V/A719C/I756V | + |
| 1211/1212 | V68A/G189R/I272L/V316I/D477K/A719C/I756V | + |
| 1213/1214 | V126L/V314L/N499H/D549E/G589E/R755G | + |
| 1215/1216 | Q95S/Q444T/R478V/K724H/H788E | + |
| 1217/1218 | Q95S/R385L/R478V/R583Q/H788E | + |
| 1219/1220 | V68A/D146N/S248A/V387I/S506P/R550H | + |

[a]Levels of increased production were determined relative to the reference polypeptide of SEQ ID NO: 1080, and defined as follows:
"+" = production at least that of the reference polypepide, but less than 1.2-fold; and
"++" = at least 1.2-fold increased production, as compared to the reference polypeptide.

Characterization of SuS Shake Flask Powders with a Coupled Assay for Glucosylation of Rebaudioside A Using ADP-glucose Produced by SuS from Sucrose and ADP First, SuS lyophilized shake flask powders were reconstituted in water and added for final concentrations ranging from 0.025-1 g/L of protein in total reaction volume. The reaction conditions were as follows: 50 mM potassium phosphate buffer, pH 7, 3 mM $MgCl_2$, with 1 mM rebaudioside A (>97% purity), 10 mM sucrose (Sigma), and 1 mM ADP (Sigma). The GT added to catalyze the glucosyl transfer from ADP-glucose to rebaudioside A was SEQ ID NO: 548 at 2 g/L final concentration in 100 µL total reaction volume. The reaction was performed at 50° C. in a Thermotron® titre-plate shaker with 300 RPM shaking for 1 h. The reaction described above was quenched by adding 10 µL assay to 90 µL acetonitrile with 0.2% formic acid and precipitated by centrifugation. Glycosylated products were detected in the supernatant by RapidFire SPE-MS/MS following 1:10 dilution in water with the instrument and parameters described in Example 9, Table 9.3. The relative levels of rebaudioside I produced from rebaudioside A in the coupled shake flask powder assays are listed in Table 19.2.

TABLE 19.2

Round 2 Shake Flask Powder Characterization in Coupled Assay

| SEQ ID NO: (nt/aa) | Amino Acid Differences (Relative to SEQ ID NO: 1080) | RebI Levels[a] |
|---|---|---|
| 1161/1162 | M75V/A105E/R154H/I215F/I264V/A345T | ++ |
| 1153/1154 | R136S/R440P/Q444T/R478T/G603S | + |
| 1165/1166 | R85V/I170L/A225E/R266N/E534H | + |
| 1157/1158 | I113L/A225E/R266N/R415K | + |
| 1163/1164 | A225E/I372V/E534H | − |

[a]Levels of increased production were determined relative to the reference polypeptide of SEQ ID NO: 1080, and defined as follows:
"−" = production less than 0.8-fold;
"+" = production at least 0.8-fold, but less than 1.2-fold; and
"++" = at least 1.2-fold increased production, as compared to the reference polypeptide.

Example 20

Sucrose Synthase Variants of SEQ ID NO: 1158

Directed evolution of the SuS encoded by SEQ ID NO: 1157 (i.e., SEQ ID NO: 1158) was continued by constructing libraries of variant genes in which mutations associated with improved activity above were recombined. These libraries were then plated, grown, and screened using the high-throughput (HTP) assay described below, to provide a third round ("Round 3") of 34 engineered SuS variant polypeptides with activity towards the generation of ADP-glucose. HTP Coupled Assay for Glucose Transfer from Sucrose to ADP to Rebaudioside A Libraries were screened using the following high-throughput (HTP) enzyme coupled assay: 10 μL SuS lysate and 2 g/L GT SEQ ID NO: 548 in 100 μL reaction volume with substrate loading of 1 mM rebaudioside A (>97% purity) and co-substrate loadings of 1 mM ADP (Sigma, >95%) and 10 mM sucrose (Sigma). The following reaction conditions were used: 50 mL potassium phosphate buffer, pH 7, 3 mM MgCl$_2$, 50° C. in a Thermotron® titre-plate shaker with 300 RPM shaking for 1 h. The reaction described above was quenched by adding 10 μL assay to 90 μL acetonitrile with 0.2% formic acid and precipitated by centrifugation. The supernatant was diluted 1:10 in water and steviol glycoside products were detected by RapidFire SPE-MS/MS with the instrument and parameters described in Example 9, Table 9.3. After analysis, 56 engineered SuS variant polypeptides that showed activity coupled with a GT on rebaudioside A were retested in triplicate with the same conditions and 2.5-fold reduced lysate load. The resulting engineered polypeptides are listed in Table 20.1.

Shake-flask scale cultures were grown for protein characterization as described in Example 1 for variants with the amino acid mutations shown in Table 20.1 (relative to SEQ ID NO: 1158).

TABLE 20.1

Round 3 Variants and RebI Levels

| SEQ ID NO: (nt/aa) | Amino Acid Differences (Relative to SEQ ID NO: 1158) | RebI Levels[a] |
|---|---|---|
| 1221/1222 | R85V/I87E/A105E/I215F/I267V/I756V | ++++ |
| 1223/1224 | H47L/R85V/T125E/I372V/R583Q/A635S/1I756V | ++++ |
| 1225/1226 | H47L/R85V/I87E/R154H/I756V | ++++ |
| 1227/1228 | R85V/I87E/R129E/W375Y/I756V/Q776E | +++ |
| 1229/1230 | V68A/R93V/L98V/R136S/S248A/S250D/P358E/R440P/E534H/K724H | +++ |
| 1231/1232 | H47L/R85V/I87E/A105E/T125E/A635S | +++ |
| 1233/1234 | H47L/R129E/I170L/A635S | +++ |
| 1235/1236 | Q8M/R136S/S248A/R478V/H788E | +++ |
| 1237/1238 | H47L/R85V/A105E/R129E/Q201E/N230D/I267V/R583Q | ++ |
| 1239/1240 | H47L/M75V/R85V/A105E/T125E/R129E/I170L/A635S | ++ |
| 1241/1242 | M75V/R85V/R129E/R154H/I264V/W375Y | ++ |
| 1243/1244 | I87E/T125E/R129E/I170L/N230D/I756V | ++ |
| 1245/1246 | H47L/M75V/R85V/I264V/I267V/I372V/K415R/A635S | ++ |
| 1247/1248 | H47L/R85V/I170L/I756V | ++ |
| 1249/1250 | Q8M/Q95S/L98V/R440P/R478V/E534H/V600I/H788E | ++ |
| 1251/1252 | Q8M/V68A/L98V/R221H/S248A/S250D/R440P/D477K/E534H/I595V/K724H | ++ |
| 1253/1254 | Q8M/V68A/Q95S/L98V/P358E/R478T/I595V/K724H/M792S | ++ |
| 1255/1256 | Q95S/R440P/Q444T/K724H/H788E | ++ |
| 1257/1258 | I87E/R154H/R306L/W375Y/I756V | ++ |
| 1259/1260 | I170L/I264V/I267V | ++ |
| 1261/1262 | M75V/R85V/I87E/A105E/I264V/I267V/R583Q/T708A | ++ |
| 1263/1264 | Q8M/R93V/Q95S/L98V/R136S/R221H/I595V/V600I/H788E | ++ |
| 1265/1266 | V68A/R93V/Q95S/P358E/R440T/Q444T/R478V/E534H/I595V/G603S | ++ |
| 1267/1268 | H47L/R154H/I372V/W375Y/R583Q/A635S/T708A/I756V | ++ |
| 1269/1270 | H47L/M75V/R85V/A105E/VV375Y/I756V/Q776E | ++ |
| 1271/1272 | R129E/I215F/I372V/I756V | ++ |
| 1273/1274 | V68A/R93V/Q95S/Q444T/H788E | ++ |
| 1275/1276 | H47L/M75V/R85V/I87E/I170L/I372V/I756V | ++ |
| 1277/1278 | Q8M/R93V/Q95S/L113I/S250D/R440T/I595V/V600I/K724H/H788E | + |
| 1279/1280 | H47L/M75V/R85V/I87E/R129E/W375Y/Q776E | + |
| 1281/1282 | R93V/Q95S/L98V/E534H/M792S | + |
| 1283/1284 | Q8M/V68A/H788E | + |
| 1285/1286 | H47L/T125E/R129E/W375Y/I756V/Q776E | + |
| 1287/1288 | R85V/T125E/I215F/W375Y/K415R/A635S/Q776E | + |

[a]Levels of increased production were determined relative to the reference polypeptide of SEQ ID NO: 1158, and defined as follows:
"+" = production at least that of the reference polypeptide, but less than 1.5-fold;
"++" = production at least 1.5-fold, but less than 2-fold;
"+++" = production at least 2-fold, but less than 2.5-fold; and
"++++", at least 2.5-fold increased production, as compared to the reference polypeptide.

Characterization of SuS Shake Flask Powders with a Coupled Assay for Glucosylation of Rebaudioside A Using ADP-glucose Produced by SuS from Sucrose and ADP First, SuS lyophilized shake flask powders were reconstituted in water and added for final concentrations ranging from 0.025-5 g/L of protein in total reaction volume. The reaction conditions were as follows: 50 mM potassium phosphate buffer, pH7, 3 mM $MgCl_2$, with 1 g/L rebaudioside D, 10 mM sucrose (Sigma), and 1 mM ADP (Sigma). The GT added to catalyze the glucosyl transfer from ADP-glucose to rebaudioside A was SEQ ID NO: 561/562 at 1 g/L final concentration in 100 µL total reaction volume. The reaction was performed at 50° C. in a Thermotron® titre-plate shaker with 300 RPM shaking for 1h. The reaction described above was quenched by adding 10 µL assay to 90 µL acetonitrile with 0.2% formic acid and precipitated by centrifugation. Glycosylated products were detected in the supernatant by RapidFire SPE-MS/MS following 1:10 dilution in water with the instrument and parameters described in Example 9, Table 9.3. The relative levels of rebaudioside M produced from rebaudioside D in the coupled shake flask powder assays are listed in Table 20.2.

TABLE 20.2

Round 3 Shake Flask Powder Characterization in Coupled Assay

| SEQ ID NO: (nt/aa) | Amino Acid Differences (Relative to SEQ ID NO: 1158) | RebM Levels[a] |
|---|---|---|
| 1225/1226 | H47L/R85V/I87E/R154H/I756V | ++ |
| 1221/1222 | R85V/I87E/A105E/I215F/I267V/I756V | ++ |
| 1229/1230 | V68A/R93V/L98V/R136S/S248A/S250D/P358E/R440P/E534H/K724H | + |
| 1227/1228 | R85V/I87E/R129E/W375Y/I756V/Q776E | + |
| 1223/1224 | H47L/R85V/T125E/I372V/R583Q/A635S/I756V | + |

[a]Levels of increased production were determined relative to the reference polypeptide of SEQ ID NO: 1158, and defined as follows:
"+" = production at least that of the reference polypeptide, but less than 1.7-fold; and
"++" = at least 1.7-fold increased production, as compared to the reference polypeptide.

Expression Analysis of SuS Enzymes

The three rounds of engineered SuS polypeptides for ADP recycle with sucrose were analyzed by polyacrylamide gel-electrophoresis to determine relative protein expression levels. Samples were prepared with 1×LDS loading buffer and 1× reducing agent (Life Technologies). A 4-12% Bis-Tris acrylamide gel (Life Technologies) was loaded with 5 µg per lane of lyophilized soluble crude lysate from shake flask scale cultures and run with MES running buffer for 25 min at 200 V, and bands were quantified using ImageJ analysis software. The relative expression levels are listed in Table 20.3. SEQ ID NOs: 1079/1080, 1157/1158, and 1221/1222 are significantly better expressed genes and/or significantly better folded/more stable proteins. These produce more protein than the wild type gene.

TABLE 20.3

Protein Levels of Engineered SuS Variants

| SEQ ID NO: (nt/aa) | Increased Protein[a] |
|---|---|
| 1079/1080 | +++ |
| 1157/1158 | ++ |
| 1221/1222 | ++ |

[a]Levels of increased protein were determined relative to the reference polypeptide of SEQ ID NO: 74, and defined as follows:
"+" = band intensity at least that of the reference polypeptide, but less than 2-fold;
"++" = band intensity at least 2-fold, but less than 3-fold; and
"+++" = at least 3-fold increased band intensity, relative to the reference polypeptide.

Example 21

Transformation of Stevioside to Rebaudioside A with AGT and ACSuS

In this Example, experiments conducted to produce rebaudioside A using AGT and ACSuS are described. The buffer used was 50 m pH7.0 potassium phosphate with 3 mM $MgSO_4$. Enzyme and sucrose stock solutions (400 µL) were prepared in the buffer. "Reb A60" was a ~1:2 mixture of stevioside and rebaudioside A respectively. To a vial under air was added 250 µL of 8 µL β-1,3-GT SEQ ID NO: 1290 stock solution, 250 µL of 2 g/L SuS SEQ ID NO: 1158 stock solution and 500 µL of 50 g/L Reb A60 and 2.6 µg/L ADP stock solution in 400 g/L of sucrose. The final compositions was 25 g/L Reb A60, 200 g/L sucrose, 2 g/L SEQ ID NO: 1290, 0.5 g/L SEQ ID NO: 1158, and 1.3 g/L (3 mM) of ADP. The resulting clear homogenous solution was stirred under air (the reaction gradually turned cloudy with formation of precipitates). The progress of the reaction was followed by taking aliquots and quenched with 1:1 acetonitrile/water. After centrifuging at 4000 rpm/r.t./5 min, the clear homogeneous supernatant was analyzed by HPLC using the instrument and parameters listed in Table 21.1 and Table 21.2. After 48h, the reaction mixture consisted of >90% RebA (Table 21.3).

TABLE 21.1

Analytical HPLC Method Steviol Glycosides

| Instrument | Agilent HPLC 1100 series |
|---|---|
| Column | 3.5 × 50 mm 3.5 µm Waters XBridge Phenyl column |
| Mobile phase | Isocratic 65:35 A:B<br>A: 0.1% formic acid in water<br>B: 0.1% formic acid in methanol |
| Flow rate | 2.4 mL/m |
| Run time | 12 m |
| Peak retention times | Rebaudioside D: 3.7 m<br>Rebaudioside M: 4.7 m<br>Stevioside: 8.8 m<br>Rebaudioside A and I: 9.9 m |
| Column temperature | 50° C. |
| Injection volume | 10 µL |
| UV detection | 210 nm |

TABLE 21.2

Analytical HPLC Method Steviol Glycosides

| Instrument | Thermo Ultimate 3000 UPLC with CAD |
|---|---|
| Column | 3.2 × 250 mm 3.5 µm Restek Pinnacle II Amino column |

TABLE 21.2-continued

Analytical HPLC Method Steviol Glycosides

| | |
|---|---|
| Mobile phase | Isocratic 22:78 A:B |
| | A: water |
| | B: acetonitrile |
| Flow rate | 2.0 mL/m |
| Run time | 12 m |
| Peak retention times | Fructose: 1.7 m |
| | Glucose: 2.0 m |
| | Stevioside: 2.6 m |
| | Sucrose: 3.1 m |
| | Rebaudioside A: 4.2 m |
| | Rebaudioside I: 6.6 m |
| | Rebaudioside D: 10.0 m |
| | Rebaudioside M: 10.7 m |
| Column temperature | 50° C. |
| Injection volume | 10 μL |
| UV detection | 210 nm for organic compounds |
| | CAD for sugars |

TABLE 21.3

Conversion of Stevioside to Rebaudioside A Over Time

| t [h] | % stevioside | % Reb A |
|---|---|---|
| 0 | 36 | 64 |
| 1 | 35 | 65 |
| 2 | 33 | 67 |
| 4 | 31 | 69 |
| 8 | 27 | 73 |
| 24 | 18 | 82 |
| 48 | 8 | 92 |
| 72 | 6 | 94 |

Example 22

Transformation of Stevioside to Rebaudioside A and Rebaudioside A to Rebaudioside D with AGT and ACSuS In this Example, experiments conducted to produce rebaudioside A and rebaudioside D are described. To a vial under air was added 250 μL of 20 g/L β-1,3-GT SEQ ID NO: 1290 stock solution, 250 μL of 40 g/L β-1,2-GT SEQ ID NO: 954 stock solution and 500 μL of 20 g/L Reb A 60, 2.6 g/L ADP and 1 g/L SuS SEQ ID NO: 1158 stock solution in 400 g/L of sucrose. The buffer used was 50 mM pH 7.0 potassium phosphate with 3 mM MgSO$_4$. Enzyme and sucrose stock solution (400 g/L) was prepared in the buffer. The final compositions was 10 g/L Reb A 60, 200 g/L sucrose, 5 g/L SEQ ID NO: 1290, 10 g/L SEQ ID NO: 954, 0.5 g/L SEQ ID NO: 1158, and 1.3 g/L (3 mM) of ADP. The resulting clear homogenous solution was stirred under air (the reaction gradually turned cloudy with formation of precipitates). The progress of the reaction was followed by taking aliquots and quenched with 1:1 acetonitrile/water. After centrifuging at 4000 rpm/r.t./5 min, the clear homogeneous supernatant was analyzed by HPLC using the instrument and parameters listed in Table 21.1 and Table 21.2. After 24 h, no stevioside remained and formation of 16% of Reb D was observed (Table 22.1).

TABLE 22.1

Conversion of Stevioside and Rebaudioside A to Rebaudioside A and Rebaudioside D

| t [h] | % stevioside | % Reb A | % Reb D |
|---|---|---|---|
| 0 | 35 | 65 | 0 |
| 1 | 27 | 70 | 3 |
| 2 | 25 | 70 | 5 |
| 4 | 23 | 72 | 5 |
| 8 | 15 | 79 | 6 |
| 24 | 0 | 84 | 16 |

Example 23

Transformation of Rebaudioside D to Rebaudioside M with AGT and ACSuS

In this Example, experiments conducted to produce rebaudioside M from rebaudioside D using AGT and ACSuS variants are described. To a vial under air was added 100 mg of Reb D, 250 μL of 80 g/L β-1,3-GT SEQ ID NO: 548 stock solution, 250 μL of 10 g/L SuS SEQ ID NO: 1158 stock solution and 500 μL of 2.6 g/L ADP stock solution in 400 g/L of sucrose. The buffer used was 50 mM pH 7.0 potassium phosphate with 3 mM MgSO$_4$. Enzyme and sucrose stock solution (400 g/L) was prepared in the buffer. The final compositions was 100 g/L Reb D, 200 g/L sucrose, 20 g/L SEQ ID NO: 548, 2.5 g/L SEQ ID NO: 1158, and 1.3 g/L (3 mM) of ADP. The resulting thick slurry was stirred under air. The progress of the reaction was followed by taking aliquots and quenched with 1:1 acetonitrile/water. After centrifuging at 4000 rpm/r.t./5 min, the clear homogeneous supernatant was analyzed by HPLC using the instrument and parameters listed in Table 21.1 and Table 21.2. After 48 h, the reaction mixture consisted of >90% Reb M (Table 23.1).

TABLE 23.1

Conversion of Rebaudioside D to Rebaudioside M Over Time.

| t [h] | % Reb M |
|---|---|
| 0 | 0 |
| 1 | 16 |
| 2 | 28 |
| 4 | 40 |
| 8 | 52 |
| 24 | 79 |
| 32 | 88 |
| 48 | 94 |

Example 24

Transformation of Stevioside to Rebaudioside A, Rebaudioside A to Rebaudioside D, and Rebaudioside D to Rebaudioside M with AGT and ACSuS In this Example, experiments conducted to produce rebaudioside A from stevioside, rebaudioside D from rebaudioside A, and rebaudioside M from rebaudioside D are described. To a vial under air was added 250 μL of 20 g/L β-1,3-GT SEQ ID NO: 1290 stock solution, 250 μL of 40 g/L β-1,2-GT SEQ ID NO: 954 stock solution, and 500 μL of 50 g/L Reb A 60, 2.6 g/L ADP, 5 g/L β-1,3-GT SEQ ID NO: 548, and 1 g/L SuS SEQ ID NO: 1158 stock solution, in 400 g/L of sucrose. The buffer used was 50 mM pH 7.0 potassium phosphate with 3 mM MgSO$_4$. Enzyme and sucrose stock solution (400 g/L) was prepared in the buffer. The final compositions was 25 g/L Reb A 60, 200 g/L sucrose, 5 g/L SEQ ID NO: 1290, 10 g/L SEQ ID NO: 954, 2.5 g/L SEQ ID NO: 548, 0.5 g/L SEQ ID NO: 1158 and 1.3 g/L (3 mM) of ADP. The resulting clear homogenous solution was stirred under air (the reaction gradually turned cloudy with formation of precipitates). The progress of the reaction was followed by taking aliquots and quenched with 1:1 acetonitrile/water. After centrifuging at 4000 rpm/r.t./5 min, the clear homogeneous supernatant was analyzed by HPLC using the instrument and parameters listed in Table 21.1 and Table 21.2. After 24 h, <5% stevioside remained and formation of 9% of Reb M was observed (Table 24.1).

TABLE 24.1

Conversion of Stevioside and Rebaudioside A to Glucosylated Products Over Time.

| t [h] | % stevioside | % Reb A | % Reb D | % Reb I | % Reb M |
|---|---|---|---|---|---|
| 0 | 35 | 65 | 0 | 0 | 0 |
| 1 | 29 | 71 | 0 | 0 | 0 |
| 2 | 26 | 73 | 0 | 1 | 0 |
| 4 | 2 | 97 | 0 | 1 | 0 |
| 8 | 8 | 91 | 0 | 1 | 0 |
| 24 | 1 | 70 | 0 | 18 | 9 |

Example 25

Immobilization of AGT and/or ACSuS

In this Example, experiments conducted to immobilize an AGT (e.g., the variants of SEQ ID NOS: 1290, 954, and/or 548) and/or an ACSuS variant (e.g., SEQ ID NO:1158) are described. To a vessel is added the enzyme solution, either alone or as a combination of enzymes (i.e., AGT and/or ACSuS enzymes), and the solid support. The solid support is cationic, anionic, hydrophobic, hydrophilic with or without the presence of covalent bond forming functional groups such as thiol, alcohol, amines, olefin, alkyl halide and/or epoxide. The solid support is either a discrete polymeric resin or amorphous (nano) clay or activated carbon. The magnetic particle is used when it is suitable for product isolation/enzyme recycling. The reaction is carried out in the presence or absence of glutaraldehyde. The progress of enzyme uptake by the solid support is followed by Bradford assay. Alternatively, the solid support is packed in a column and the enzyme solution is flowed through the column, with recycling if necessary, until the desired degree of enzyme capture is reached. In some embodiments, all enzymes of interest are immobilized on a same solid support in the same reaction vessel, while in some alternative embodiments, the enzymes are immobilized individually in separate vessels or a combination thereof. In some embodiments, the immobilized enzyme is either isolated via filtration or is used immediately by adding buffer, sucrose, ADP and substrate to the immobilization reaction mixture.

Example 26

Transformation of Stevioside to Rebaudioside A with Immobilized AGT and/or ACSuS and Recycling of Sugar Solution In this Example, transformation of stevioside to rebaudioside A using an immobilized AGT (e.g., SEQ ID NO: 1290) and ACSuS (e.g., SEQ ID NO: 1158), and sugar solution recycling are described. To a vessel is added immobilized β-1,3-GT (e.g., SEQ ID NO: 1290) and immobilized SuS (e.g., SEQ ID NO: 1158). Alternatively, in some embodiments, one of the enzymes is used in the immobilized form and the other is used in solution form. After the addition of buffer, sucrose, ADP and substrate (i.e., stevioside or Reb A 60), the reaction is monitored until the desired conversion is reached. In some embodiments, the product and immobilized enzyme are isolated by filtration. In some embodiments, immobilized enzyme is further separated from the product via either centrifugation, particle size filtration or magnetic retrieval and is re-used. The sugar filtrate is returned to the vessel for the next iteration.

Example 27

Transformation of Rebaudioside A to Rebaudioside D with Immobilized AGT and/or ACSuS and Recycling of Sugar Solution In this Example, experiments conducted to produce rebaudioside D from rebaudioside D with immobilized AGT and ACSuS, and sugar solution recycling are described. To a vessel is added immobilized β-1,2-GT (e.g., SEQ ID NO: 954) and immobilized SuS (e.g., SEQ ID NO: 1158). Alternatively, in some embodiments, one of the enzymes is used in the immobilized form and the other is used in solution form. After the addition of buffer, sucrose, ADP and substrate (stevioside or Reb A 60), the reaction is monitored until the desired conversion is reached. In some embodiments, the product and immobilized enzyme is isolated by filtration. In some embodiments, immobilized enzyme is further separated from the product via either centrifugation, particle size filtration or magnetic retrieval and is re-used. The sugar filtrate is returned to the vessel for the next iteration.

Example 28

Transformation of Rebaudioside D to Rebaudioside M with Immobilized AGT and/or ACSuS and Recycling of Sugar Solution In this Example, experiments conducted to produce rebaudioside M from rebaudioside D with immobilized AGT and ACSuS, and sugar solution recycling are described. To a vessel is added immobilized β-1,3-GT (e.g., SEQ ID NO: 548) and immobilized SuS (e.g., SEQ ID NO: 1158). Alternatively, in some embodiments, one of the enzymes is used in the immobilized form and the other is used in solution form. After the addition of buffer, sucrose, ADP and Reb D, the reaction is monitored until the desired conversion is reached. In some embodiments, the product and immobilized enzyme are isolated by filtration. In some additional embodiments, immobilized enzyme is further separated from the product via either centrifugation, particle size filtration or magnetic retrieval and is re-used. The sugar filtrate is returned to the vessel for the next iteration.

Example 29

Transformation of Stevioside to Rebaudioside A and Rebaudioside A to Rebaudioside D with Immobilized AGT and ACSuS and Recycling of Sugar Solution In this Example, experiments conducted to produce rebaudioside A from stevioside, and rebaudioside D from rebaudioside A with immobilized AGT and ACSuS, and sugar solution recycling are described. To a vessel is added immobilized β-1,3-GT (e.g., SEQ ID NO: 1290) and β-1,2-GT (e.g., SEQ ID NO: 954) and immobilized SuS (e.g., SEQ ID NO: 1158). Alternatively, one or two of these enzymes is used in the immobilized form and the others are used in solution form. After the addition of buffer, sucrose, ADP and substrate (stevioside or Reb A 60), the reaction is monitored until the desired conversion is reached. In some embodiments, the product and immobilized enzyme are isolated by filtration. In some embodiments, immobilized enzyme is further separated from the product via either centrifugation, particle size filtration or magnetic retrieval and is re-used. The sugar filtrate is returned to the vessel for the next iteration.

Example 30

Transformation of Stevioside to Rebaudioside A, Rebaudioside A to Rebaudioside D and Rebaudioside D to Rebaudioside M with Immobilized AGT and ACSuS and Recycling of Sugar Solution To a vessel is added immobilized β-1,3-GT (e.g., SEQ ID NO: 1290), β-1,2-GT (e.g., SEQ ID NO: 954), β-1,3-GT (e.g., SEQ ID NO: 548), and immobilized SuS (e.g., SEQ ID NO: 1158). Alternatively, in some embodiments, one, two or three of these enzymes is/are used in the immobilized form and the others are used in solution form. After the addition of buffer, sucrose, ADP and substrate (stevioside or Reb A 60), the reaction is monitored until the desired conversion is reached. In some embodiments, the product and immobilized enzyme are isolated by filtration. In some embodiments, immobilized enzyme is further separated from the product via either centrifugation, particle size filtration or magnetic retrieval and is re-used. The sugar filtrate is returned to the vessel for the next iteration.

Example 31

Sucrose Synthase Variants of SEQ ID NO: 1222

Directed evolution of the SuS encoded by SEQ ID NO: 1222 was continued by constructing libraries of variant genes in which mutations associated with improved activity in earlier rounds of evolution were recombined. These libraries were then plated, grown, and screened using the high-throughput (HTP) assay described below, to provide a fourth round ("Round 4") of 49 engineered SuS variant polypeptides with activity toward the generation of ADP-glucose.

HTP Coupled Assay for Glucose Transfer from Sucrose to ADP to Rebaudioside D

Libraries were screened using the following HTP enzyme-coupled assay. Pelleted E. coli cultures were lysed with 250 µL of Tris-HCl, pH 7.5, with 1 mM magnesium sulfate and 0.5 mg/mL lysozyme and polymyxin B sulfate (PMBS) and cleared by centrifugation. Lysate was diluted 20× into Tris-HCl, pH 7.5. Then, 10 µL diluted SuS lysate and 2 g/L GT SEQ ID NO: 696 (Rd8BB) were combined in 100 µL reaction volume with substrate loading of ~1 mM rebaudioside D and co-substrate loadings of 1 Mm ADP (Sigma, >95%) and 10 mM sucrose (Sigma). The following reaction conditions were used: 50 mM potassium phosphate buffer, pH7, 3 mM $MgCl_2$, 50° C., in a Thermotron® titre-plate shaker with 300 RPM shaking for 2h. The reaction described above was quenched by adding 10 µL assay mixture to 90 µL acetonitrile with 0.2% formic acid, and precipitated by centrifugation. The supernatant was diluted 10× in water and steviol glycoside products were detected by RapidFire SPE-MS/MS, with the instrument and parameters described in Table 31.1.

TABLE 31.1

RapidFire SPE-MS/MS Conditions for Steviol Glycoside Detection.

| Agilent RapidFire Conditions | |
|---|---|
| Buffer A | 0.1% formic acid in LC/MS grade water; 1.5 mL/min flow rate |
| Buffer B | 0.1% formic acid in LC/MS grade methanol; 0.8 mL/min flow rate |
| Aqueous wash | Water |
| Organic wash | Acetonitrile |
| SPE cartridge | Agilent RapidFire cartridge A (C4) |
| RF state 1 | 600 ms |
| RF state 2 | 2500 ms |
| RF state 3 | 0 |
| RF state 4 | 5000 ms |
| RF state 5 | 1000 ms |

| Agilent Jet Stream Source Parameters | |
|---|---|
| Drying gas temperature | 300° C. |
| Drying gas flow | 10 L/min |
| Nebulizer pressure | 45 psi |
| Sheath gas temperature | 350° C. |
| Sheath gas flow | 11 L/min |
| Capillary voltage | +3500 V |
| Nozzle voltage | +2000 V |

| Agilent 6470 Triple Quadrupole MRM Parameters | | | | | | |
|---|---|---|---|---|---|---|
| Compound | Q1 | Q3 | Dwell | Fragmentor | CE | CAV |
| Stevioside | 827.4 | 665.3 | 50 | 150 | 50 | 5 |
| RebA | 989.5 | 827.5 | 50 | 350 | 60 | 5 |
| RebD or RebI | 1151.7 | 827.5 | 50 | 350 | 55 | 5 |
| RebM | 1313.7 | 827.5 | 50 | 350 | 70 | 5 |

After analysis, 49 engineered SuS variant polypeptides that showed improved activity coupled with a GT on rebaudioside D were identified. The resulting engineered polypeptides are listed in Table 31.2. Shake-flask scale cultures were grown for protein characterization as described in below for variants with the amino acid mutations shown in Table 31.3.

TABLE 31.2

SUS Round 4 Variants and RebM Levels

| SEQ ID NO: (nt/aa) | Amino Acid Differences (Relative to SEQ ID NO: 1222) | Increased RebM$^a$ |
|---|---|---|
| 1295/1296 | H47L/I372V/A635S/Q776E | + |
| 1297/1298 | H47L/R93V/L98V/P358E/R583Q/A635S | + |
| 1299/1300 | V68A/R93V/R154H/P358E/I372V/R440P/Q776E | + |
| 1301/1302 | I372V/W375Y/Q776E | + |
| 1303/1304 | H47L/L98V/R129E/P358E/I372V/W375Y/H438Q/E534H | + |
| 1305/1306 | R154H/E534H/A635S/K724H | + |
| 1307/1308 | R93V/R154H/S248A/K724H | + |
| 1309/1310 | H47L/R93V/P358E/I372V/W375Y/Q776E | + |
| 1311/1312 | V68A/R136S/K724H | + |
| 1313/1314 | H47L/P358E/A635S/Q776E | + |
| 1315/1316 | L98V/E534H/R583Q/A635S | + |
| 1317/1318 | R93V/L98V/T125E/R154H/S250D/R440P | + |
| 1319/1320 | R93V/L98V/R154H/A635S/Q776E | +++ |
| 1321/1322 | R129E/R154H/S248A/S250D/P358E/W375Y/E534H/A635S | +++ |

TABLE 31.2-continued

SUS Round 4 Variants and RebM Levels

| SEQ ID NO: (nt/aa) | Amino Acid Differences (Relative to SEQ ID NO: 1222) | Increased RebM[a] |
|---|---|---|
| 1323/1324 | R93V/T125E/R154H/R440P/E534H | ++ |
| 1325/1326 | R93V/L98V/E534H | + |
| 1327/1328 | R93V/L98V/R154H/S250D/P358E/W375Y/E534H | ++ |
| 1329/1330 | H47L/L98V/I372V/W375Y | ++ |
| 1331/1332 | H47L/R93V/L98V/R154H/I372V/W375Y/Q776E | +++ |
| 1333/1334 | H47L/R93V/R129E/R136S/R154H/S250D/I372V/E534H/A635S/K724H | + |
| 1335/1336 | R93V/R129E/S250D/P358E/I372V/W375Y/R583Q | + |
| 1337/1338 | V68A/W375Y/R440P/E534H/K724H/Q776E | + |
| 1339/1340 | H47L/T125E/R154H | +++ |
| 1341/1342 | R93V/L98V/T125E/R154H/S248A | ++ |
| 1343/1344 | V68A/R154H/E534H/A635S | ++ |
| 1345/1346 | H47L/R93V/R129E/R136S/W375Y/E534H/R583Q | ++ |
| 1347/1348 | V68A/R129E/R583Q/K724H | ++ |
| 1349/1350 | H47L/R93V/L98V/R136S/R154H/E772G/Q776E | +++ |
| 1351/1352 | H47L/R136S/R583Q/Q776E | ++ |
| 1353/1354 | R154H/S250D/P358E/W375Y/R583Q | +++ |
| 1355/1356 | H47L/R129E/S248A/S250D/I372V/W375Y/E534H/K724H | + |
| 1357/1358 | W375Y/A635S | + |
| 1359/1360 | H47L/P358E/R440P/K724H | + |
| 1361/1362 | R129E/R136S/W375Y | + |
| 1363/1364 | H47L/V68A/R93V/L98V/P358E/R440P | + |
| 1365/1366 | L98V/R129E/W375Y/R583Q | + |
| 1367/1368 | R93V/P358E/E534H/A635S | + |
| 1369/1370 | E534H/R583Q | + |
| 1371/1372 | H47L/V68A/R154H/I372V/W375Y | + |
| 1373/1374 | R129E/P358E/I372V/A635S | ++ |
| 1375/1376 | H47L/R129E/R136S/I372V/W375Y/E534H | ++ |
| 1377/1378 | R93V/L98V/R129E/R154H/S248A | ++ |
| 1379/1380 | V68A/R129E/R440P | +++ |
| 1381/1382 | R154H/P358E/W375Y/E534H/Q776E | +++ |
| 1383/1384 | H47L/L98V/R129E/W375Y/E534H/A635S/K724H/Q776E | ++ |
| 1385/1386 | V68A/R154H/P358E/W375Y | ++ |
| 1387/1388 | V68A/R93V/L98V/R129E/P358E/W375Y/K724H | ++ |
| 1389/1390 | R129E/R136S/R154H/S248A/S250D/I372V/W375Y/E534H | ++ |
| 1391/1392 | H47L/R93V/P358E/I372V/W375Y/R440P/K724H | +++ |

[a] Levels of increased production were determined relative to the reference polypeptide of SEQ ID NO: 1222, and are defined as follows:
"+" = production at least 2-fold, but less than 3.05-fold;
"++" = at least 3.05-fold, but less than 3.29-fold; and
"+++" = at least 3.29-fold increased production, as compared to the reference polypeptide.

Production of Shake Flask Powders (SFP)

A shake-flask procedure was used to generate the glycosyltransferase polypeptide shake flask powders (SFP) for characterization assays used in the biocatalytic processes described herein. Shake flask powder (SFP) preparation of enzymes provides amore purified preparation (e.g., up to >30% of total protein) of the enzyme, as compared to the cell lysate used in HTP assays, and also allows for the use of more concentrated enzyme solutions. A single colony of *E. coli* containing a plasmid encoding an engineered polypeptide of interest was inoculated into 5 mL Luria Bertani broth containing 30 μg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7.0, 1 mM MgSO$_4$) containing 30 μg/ml CAM, in a 1 L flask to an optical density of 600 nm (OD600) of 0.2, and allowed to grow at 30° C.

Shake Flask Powder Characterization Assay and Analysis for Glucosyl Transfer from Sucrose to Rebaudioside D An experiment was performed to characterize the activity of the engineered round 4 SUS variants on sucrose and ADP to facilitate the formation of rebaudioside M from rebaudioside D. Shake flask powder (SFP) was added to a 100 μL total reaction volume at 0.125 g/L concentration containing 50 mM potassium phosphate buffer, pH 7, 3 mM magnesium chloride, 1 g/L rebaudioside D, 10 mM sucrose, 1 mM ADP, and 2 g/L GT SEQ ID NO: 734. The reaction was performed at 50° C. in a Thermotron® titre-plate shaker with 300 RPM shaking for 1 h. The reaction was quenched by adding 10 μL of the reaction mixture to 90 μL acetonitrile with 0.2% formic acid, and precipitated by centrifugation. The supernatant was diluted 10× in water and analyzed for steviol glycosides by RapidFire SPE-MS/MS, with the instrument and parameters described in Table 31.1. At least 3 of the variants had higher activities than SEQ ID NO: 1222. The levels of rebaudioside M produced from rebaudioside D by the variants relative to SEQ ID NO: 1222 are listed in Table 31.3. The variant with mutations H47L, R93V, P358E, I372V, W375Y, R440P, and K724H (SEQ ID NO: 1392), relative to SEQ ID NO: 1222, had the highest activity. Therefore, the encoding polynucleotide (SEQ ID NO: 1391) was selected for further directed evolution for the catalysis of the recycling reaction transferring a glucose from sucrose to ADP.

TABLE 31.3

SUS Round 4 SFP Variants and RebM Levels

| SEQ ID NO: (nt/aa) | Amino Acid Differences (Relative to SEQ ID NO: 1222) | Increased RebM[a] |
|---|---|---|
| 1391/1392 | H47L/R93V/P358E/I372V/W375Y/R440P/K724H | + |
| 1349/1350 | H47L/R93V/L98V/R136S/R154H/E772G/Q776E | + |
| 1381/1382 | R154H/P358E/W375Y/E534H/Q776E | + |
| 1365/1366 | L98V/R129E/W375Y/R583Q | + |
| 1379/1380 | V68A/R129E/R440P | + |
| 1391/1392 | H47L/R93V/P358E/I372V/W375Y/R440P/K724H | + |

[a] Levels of increased production were determined relative to the reference polypeptide of SEQ ID NO: 1222, and defined as follows:
"+" = production at least 1.04-fold, but less than 1.2-fold greater productivity, as compared to the reference polypeptide.

Example 32

Sucrose Synthase Variants of SEQ ID NO: 1392

Directed evolution of the SuS encoded by SEQ ID NO: 1391 was continued by constructing libraries of variant genes in which mutations associated with improved activity in earlier rounds of evolution were recombined. These libraries were then plated, grown, and screened using the high-throughput (HTP) assay described below, to provide a fifth round ("Round 5") of 86 engineered SuS variant polypeptides with activity toward the generation of ADP-glucose.

HTP Coupled Assay for Glucose Transfer from Sucrose to ADP to Rebaudioside D

Libraries were screened using the following HTP enzyme-coupled assay. Pelleted *E. coli* cultures were lysed with 400 μL of Tris-HCl, pH 7.5 with 1 mM magnesium sulfate and 0.5 mg/mL lysozyme and polymyxin B sulfate (PMBS) and cleared by centrifugation. Lysate was diluted 25-60× into Tris-HCl, pH 7.5. 10 μL diluted SuS lysate and 2 g/L GT SEQ ID NO: 4684 (Rd9BB) in 100 µL reaction volume with substrate loading of ~1 mM rebaudioside D and co-substrate loadings of 1 mM ADP (Sigma, >95%) and 10 mM sucrose (Sigma). The following reaction conditions were used: 50 mM potassium phosphate buffer, pH 7, 3 mM MgCl$_2$, 50° C. in a Thermotron® titre-plate shaker with 300 RPM shaking for 1 h. The reaction described above was quenched by adding 10 µL assay to 90 µL acetonitrile with 0.2% formic acid, and precipitated by centrifugation. The supernatant was diluted 10× in water and steviol glycoside products were detected by RapidFire SPE-MS/MS, with the instrument and parameters described in Table 31.1.

After analysis, 86 engineered SuS variant polypeptides that showed improved activity coupled with a GT on rebaudioside D were identified. The resulting engineered polypeptides are listed in Table 32.1. Shake-flask scale cultures were grown for protein characterization as described in below for variants with the amino acid mutations shown in Table 32.2.

TABLE 32.1

SUS Round 5 Variants and RebM Levels

| SEQ ID NO: (nt/aa) | Amino Acid Differences (Relative to SEQ ID NO: 1392) | Increased RebM[a] |
|---|---|---|
| 1395/1396 | G54D/A97V/A118N/N307E/G694N/L727E/A738E | + |
| 1397/1398 | A97V/A118N/H442N/G694N/L727E/A738E | + |
| 1399/1400 | Y17D/F684H | + |
| 1401/1402 | Y17D/Y434H/F684H | + |
| 1403/1404 | Y17D/Y357K/Y434H/F519T/F684H | ++ |
| 1405/1406 | Y17D/Y357K/P364R/Y434H/F519T/F684H | ++ |
| 1407/1408 | R550I | + |
| 1409/1410 | V68A/L98V/R129E/R136S | ++ |
| 1411/1412 | R136S/G603D | ++ |
| 1413/1414 | L98V/R136S/R154H/A635S | ++ |
| 1415/1416 | V68A/R136S/E534H/A635S | ++ |
| 1417/1418 | V68A/R154H | ++ |
| 1419/1420 | V68A/R129E/R136S/R154H | ++ |
| 1421/1422 | L98V/R129E/R136S/R154H/A635S | +++ |
| 1423/1424 | V68A/L98V/R154H/E534H/A635S | ++ |
| 1425/1426 | L98V/R154H | + |
| 1427/1428 | R136S/E534H/A635S | + |
| 1429/1430 | L98V/R154H/E534H | ++ |
| 1431/1432 | V68A/L98V/R136S/R154H/A635S | ++ |
| 1433/1434 | R129E/A635S | + |
| 1435/1436 | R129E/R154H/A635S | +++ |
| 1437/1438 | V68A/L98V/R154H/E534H | + |
| 1439/1440 | V68A/R129E/R136S | + |
| 1441/1442 | V68A/R129E/R136S/R154H/I464R/A635S | +++ |
| 1443/1444 | L98V/R129E/R154H | +++ |
| 1445/1446 | R154H/A635S | ++ |
| 1447/1448 | R129E/R154H/E534H | ++ |
| 1449/1450 | R154H | + |
| 1451/1452 | L98V/R136S/A635S | ++ |
| 1453/1454 | V68A/R136S/R154H/E534H/A635S | +++ |
| 1455/1456 | V68A/L98V/R129E/R154H/A635S | +++ |
| 1457/1458 | V68A/R129E/R154H | ++ |
| 1459/1460 | V68A/R154H/A635S | ++ |
| 1461/1462 | V68A/L98V/R154H | + |
| 1463/1464 | L98V/R136S/E534H/A635S | ++ |
| 1465/1466 | V68A/L98V/R136S/R154H/E534H/A635S | +++ |
| 1467/1468 | L98V/R129E/E534H/A635S | ++ |
| 1469/1470 | V68A/L98V/R129E/R136S/R154H | ++ |
| 1471/1472 | R129E/R136S/E534H | + |
| 1473/1474 | V68A/R129E/R136S/E534H/A635S | +++ |
| 1475/1476 | V68A/R129E/R154H/D765H | +++ |
| 1477/1478 | L98V/R129E/R154H/E534H/A635S | +++ |
| 1479/1480 | V68A/R136S/A635S | ++ |
| 1481/1482 | V68A/L98V/R129E/R136S/R154H/E534H | ++ |
| 1483/1484 | R129E/R136S/A635S | +++ |
| 1485/1486 | R136S/R154H/A635S | +++ |
| 1487/1488 | L98V/R129E/R136S/E534H | + |
| 1489/1490 | L98V/R129E/R136S/R154H | ++ |
| 1491/1492 | R136S/A635S | ++ |

TABLE 32.1-continued

SUS Round 5 Variants and RebM Levels

| SEQ ID NO: (nt/aa) | Amino Acid Differences (Relative to SEQ ID NO: 1392) | Increased RebM[a] |
|---|---|---|
| 1493/1494 | R132C/R136S/R154H/E534H/A635S | ++ |
| 1495/1496 | L98V/R129E/R136S/A635S | +++ |
| 1497/1498 | R129E/R136S/R154H/A635S | +++ |
| 1499/1500 | R129E/R136S | + |
| 1501/1502 | V68A/R154H/E534H/A635S | +++ |
| 1503/1504 | V68A/L98V/R129E/R154H/E534H | +++ |
| 1505/1506 | F160W | + |
| 1507/1508 | S161Q | + |
| 1509/1510 | F160M | + |
| 1511/1512 | A635E | + |
| 1513/1514 | A253G | + |
| 1515/1516 | F160E | + |
| 1517/1518 | F160A | + |
| 1519/1520 | Q381S | + |
| 1521/1522 | R550M | + |
| 1523/1524 | F519A | + |
| 1525/1526 | P785D | + |
| 1527/1528 | R167E | + |
| 1529/1530 | L563V | + |
| 1531/1532 | A635D | ++ |
| 1533/1534 | P285A | + |
| 1535/1536 | R550Q | + |
| 1537/1538 | F519L | + |
| 1539/1540 | F519T | + |
| 1541/1542 | A635R | + |
| 1543/1544 | F519G | + |
| 1545/1546 | G157A | ++ |
| 1547/1548 | A122E | + |
| 1549/1550 | S564A | +++ |
| 1551/1552 | A122D | + |
| 1553/1554 | R550S | + |
| 1555/1556 | A253T | + |
| 1557/1558 | F160S | + |
| 1559/1560 | F160N | + |
| 1561/1562 | F519S | + |
| 1563/1564 | G157F | + |
| 1565/1566 | A253V | + |

[a]Levels of increased production were determined relative to the reference polypeptide of SEQ ID NO: 1392, and are defined as follows:
"+" = production at least 1.2-fold, but less than 1.54-fold;
"++" = at least 1.54-fold, but less than 1.73-fold; and
"+++" production at least 1.73-fold greater than that of the reference polypeptide.

Shake Flask Powder Characterization Assay and Analysis for Glucosyl Transfer from Sucrose to Rebaudioside D An experiment was performed to characterize the activity of the engineered round 4 SUS variants on sucrose and ADP to facilitate the formation of rebaudioside M from rebaudioside D. Shake flask powder (SFP) was added to a 100 µL total reaction mixture volume at 0.05 g/L concentration containing 50 mM potassium phosphate buffer, pH 7, 3 mM magnesium chloride, 1 g/L rebaudioside D, 10 mM sucrose, 1 mM ADP, and 2 g/L GT SEQ ID NO: 4684. The reaction was performed at 50° C. in a Thermotron® titre-plate shaker with 300 RPM shaking for 1-2 h. The reaction was solubilized by diluting 2.5× into water, quenched by adding 10 µL of the diluted reaction to 90 µL acetonitrile with 0.2% formic acid, and precipitated by centrifugation. The supernatant was diluted 3.33× in water and analyzed for steviol glycosides by RapidFire SPE-MS/MS, with the instrument and parameters described in Table 31.1. All of the variants in Table 32.2 had higher activities than SEQ ID NO: 1392. The levels of rebaudioside M produced from rebaudioside D by the variants relative to SEQ ID NO: 1392 are listed in Table 32.2. The variant with mutations V68A, L98V, R129E, R154H, and A635S (SEQ ID NO: 1455) relative to SEQ ID NO: 1392, was selected for further directed evolution for the catalysis of the recycling reaction transferring a glucose from sucrose to ADP.

TABLE 32.2

SUS Round 5 SFP Variants and RebM Levels

| SEQ ID NO: (nt/aa) | Amino Acid Differences SEQ ID NO: 1392) | Increased RebM[a] |
|---|---|---|
| 1393/1394 | R154Q/S161T | + |
| 1397/1398 | A97V/A118N/H442N/G694N/L727E/A738E | + |
| 1405/1406 | Y17D/Y357K/P364R/Y434H/F519T/F684H | +++ |
| 1407/1408 | R550I | + |
| 1455/1456 | V68A/L98V/R129E/R154H/A635S | ++ |
| 1477/1478 | L98V/R129E/R154H/E534H/A635S | + |
| 1497/1498 | R129E/R136S/R154H/A635S | ++ |

[a]Levels of increased production were determined relative to the reference polypeptide of SEQ ID NO: 1392, and are defined as follows:
"+" = production at least that of the reference polypeptide, but less than 1.12-fold;
"++" = production at least 1.12-fold, but less than 1.20-fold; and
"+++" = production at least 1.20-fold greater, as compared to the reference polypeptide.

Example 33

Sucrose Synthase Variants of SEQ ID NO: 1456

Directed evolution of the SuS encoded by SEQ ID NO: 1455 was continued by constructing libraries of variant genes in which mutations associated with improved activity in earlier rounds of evolution were recombined. These libraries were then plated, grown, and screened using the high-throughput (HTP) assay described below, to provide a sixth round ("Round 6") of 16 engineered SuS variant polypeptides with activity toward the generation of ADP-glucose.

HTP Coupled Assay for Glucose Transfer from Sucrose to ADP to Rebaudioside A

Libraries were screened using the following HTP enzyme-coupled assay. Pelleted *E. coli* cultures were lysed with 400 µL of Tris-HCl, pH 7.5, with 1 mM magnesium sulfate and 0.5 mg/mL lysozyme and polymyxin B sulfate (PMBS) and cleared by centrifugation. Lysate was diluted 30× into Tris-HCl, pH 7.5. Then, 10 µL diluted SuS lysate and 1 g/L GT SEQ ID NO: 2814 (Rd8BB) were combined in 100 µL reaction volume with substrate loading of 4.5 mM rebaudioside A 97 and co-substrate loadings of 0.25 mM ADP (Sigma, >95%) and 10 mM sucrose (Sigma). The following reaction conditions were used: 50 mM potassium phosphate buffer, pH 6.5, 50° C., in a Thermotron® titre-plate shaker with 300 RPM shaking for 1 h. The reaction described above was solubilized by adding 10 µL assay mixture to 90 µL water, quenched by adding 10 µL solubilized assay mixture to 90 µL acetonitrile with 0.2% formic acid, and precipitated by centrifugation. The supernatant was diluted 7.3× in water, and steviol glycoside products were detected by RapidFire SPE-MS/MS, with the instrument and parameters described in Table 31.1.

After analysis, 16 engineered SuS variant polypeptides that showed improved activity coupled with a GT on rebaudioside A were identified. The resulting engineered polypeptides are listed in Table 33.1. Shake-flask scale cultures were grown for protein characterization as described in Example 31, for variants with the amino acid mutations shown in Table 33.2.

TABLE 33.1

SUS Round 6 Variants and RebD Levels

| SEQ ID NO: (nt/aa) | Amino Acid Differences (Relative to SEQ ID NO: 1456) | Increased RebD[a] |
|---|---|---|
| 1567/1568 | Y17D/G54D/A524T/R550I/L727E | + |
| 1569/1570 | Y17D/Y434H/A524T/F684H | + |
| 1571/1572 | Y17D/A738E | + |
| 1573/1574 | Y17D/G54D/A97V/R136P/E329Q/R550I/F684H/A738E | + |
| 1575/1576 | G54D/A97V/Y434H/A524T/R550I/F684H/L727E | + |
| 1577/1578 | Y17D/S161T/Y434H/A524T/R766H | ++ |
| 1579/1580 | E329Q/R550I/F684H/L727E/A738E | + |
| 1581/1582 | Y17D/G54D/S161T/F519T/L727E/A738E | ++ |
| 1583/1584 | Y17D/Y434H/A738E | +++ |
| 1585/1586 | G54D/A97V/S161T/Y434H/H442N | +++ |
| 1587/1588 | G54D/R136P/H442N/R550I | ++ |
| 1589/1590 | Y17D/G54D/A97V/E329Q/A524T/F684H | ++ |
| 1591/1592 | G54D/Y434H/A524T/A738E | ++ |
| 1593/1594 | Y17D/H442N/A524T/R550I/F684H/E721K | + |
| 1595/1596 | Y17D/L727E | +++ |
| 1597/1598 | A97V/R136P/F519T/R550I/L727E/A738E | + |

[a]Levels of increased production were determined relative to the reference polypeptide of SEQ ID NO: 1456, and defined as follows:
"+" = production at least 1.4-fold, but less than 1.5-fold;
"++" = greater than 1.5-fold, but less than 1.54-fold; and
"+++" = greater than 1.54-fold increased production, relative to the reference polypeptide.

Shake Flask Powder Characterization Assay and Analysis for Glucosyl Transfer from Sucrose to Rebaudioside A An experiment was performed to characterize the activity of the engineered round 6 SUS variants on sucrose and ADP to facilitate the formation of rebaudioside D from rebaudioside A. Shake flask powder (SFP) was added to a 100 µL total reaction volume at 0.01 g/L concentration containing 50 mM potassium phosphate buffer, pH 6.5, 4.5 mM rebaudioside A 97, 30 mM sucrose, 0.25 mM ADP, and 1 g/L GT SEQ ID NO: 2814. The reaction was performed at 50° C. in a Thermotron® titre-plate shaker with 300 RPM shaking for 1-2 h. The reaction was solubilized by diluting 10× into water, quenched by adding 10 µL of the diluted reaction to 90 µL acetonitrile with 0.2% formic acid, and precipitated by centrifugation. The supernatant was diluted 4.4× in water and analyzed for steviol glycosides by RapidFire SPE-MS/MS, with the instrument and parameters described in Table 31.1. At least 4 of the variants had higher activities than SEQ ID NO: 1456. The levels of rebaudioside D produced from rebaudioside A by the variants relative to SEQ ID NO: 1456 are listed in Table 33.2. The variant with mutations Y17D, G54D, S161T, F519T, L727E, and A738E (SEQ ID NO: 1582) relative to SEQ ID NO: 1456, was selected for further directed evolution for the catalysis of the recycling reaction transferring a glucose from sucrose to ADP.

TABLE 33.2

SUS Round 6 SFP Variants and RebD Levels

| SEQ ID NO: (nt/aa) | Amino Acid Differences (Relative to SEQ ID NO: 1456) | Increased RebD[a] |
|---|---|---|
| 1577/1578 | Y17D/S161T/Y434H/A524T/R766H | + |
| 1581/1582 | Y17D/G54D/S161T/F519T/L727E/A738E | + |
| 1583/1584 | Y17D/Y434H/A738E | + |
| 1595/1596 | Y17D/L727E | + |

[a]Levels of increased production were determined relative to the reference polypeptide of SEQ ID NO: 1456, and defined as follows:
"+" = production between 1.15- and 1.36-fold greater than that of the reference polypeptide.

Example 34

Sucrose Synthase Variants of SEQ ID NO: 1582

Directed evolution of the sucrose synthase encoded by SEQ ID NO: 1581 was continued by constructing libraries of variant genes in which mutations associated with improved activity in earlier rounds of evolution were recombined. These libraries were then plated, grown, and screened using the high-throughput (HTP) assay described below, to provide a seventh round ("Round 7") of 87 engineered SuS variant polypeptides with activity toward the generation of ADP-glucose.

HTP Coupled Assay for Glucose Transfer from Sucrose to ADP to Rebaudioside A

Combinatorial libraries were screened using the following HTP enzyme-coupled assay. Pelleted *E. coli* cultures were lysed with 400 µL of Tris-HCl, pH 7.5 with 1 mM magnesium sulfate and 0.5 mg/mL lysozyme and polymyxin B sulfate (PMBS), and cleared by centrifugation. Lysate was diluted ~90× into Tris-HCl, pH7.5. Then, 10 µL diluted SuS lysate and 1 µL GT SEQ ID NO: 2884 (Rd9BB) were combined in 100 µL reaction volume with substrate loading of 4.5-7.5 mM rebaudioside A97 and co-substrate loadings of 0.2-0.25 mM ADP (Sigma, >95%) and 30 mM sucrose (Sigma). The following reaction conditions were used: 50 mM potassium phosphate buffer, pH 6, 55° C. in a Thermotron® titre-plate shaker with 300 RPM shaking for 2h. The reaction described above was solubilized by adding 10 µL assay to 90-190 µL water, quenched by adding 10 µL solubilized assay to 90 µL acetonitrile with 0.2% formic acid, and precipitated by centrifugation. The supernatant was diluted 4.4-6.7× in water and steviol glycoside products were detected by RapidFire SPE-MS/MS, with the instrument and parameters described in Table 31.1.

After analysis, 87 engineered SuS variant polypeptides that showed improved activity coupled with a GT on rebaudioside A were identified. The resulting engineered polypeptides are listed in Table 34.1. Shake-flask scale cultures were grown for protein characterization as described in Example 31 for variants with the amino acid mutations shown in Table 34.2.

TABLE 34.1

SUS Round 7 Variants and RebD Levels

| SEQ ID NO: (nt/aa) | Amino Acid Differences (Relative to SEQ ID NO: 1582) | Increased RebD[a] |
|---|---|---|
| 1599/1600 | L562I | ++ |
| 1601/1602 | V270L/F452Y/P517A/I700F/L750M | + |
| 1603/1604 | P517A/L562I/L750M | + |
| 1605/1606 | V270L/I367V/F452Y/P517A/E613Q/I700F/L750M | ++ |
| 1607/1608 | V270L/R570H | + |
| 1609/1610 | P517A | + |
| 1611/1612 | V270L/I322V/P517A | + |
| 1613/1614 | L562I | + |
| 1615/1616 | P517A/T640N | + |
| 1617/1618 | R71Q/R222L/R236S | ++ |
| 1619/1620 | R14D/R137K/R356H/R745L | + |
| 1621/1622 | R14D/R570H/R745L | +++ |
| 1623/1624 | R236S | ++ |
| 1625/1626 | R356H/R570H | +++ |
| 1627/1628 | R71Q/R158T/R222L/R356H | + |
| 1629/1630 | R14D/R570H | + |
| 1631/1632 | R137K/R319K/R570H | + |
| 1633/1634 | R71Q/R319K/R356H/R606S | + |
| 1635/1636 | S26E/A164E/A165E/A213E/R586E | +++ |
| 1637/1638 | G117E/A608E | ++ |
| 1639/1640 | A213E/H365E/P517E/A707E | ++ |
| 1641/1642 | G117E/R158E/A213E/G332E/A608E | + |
| 1643/1644 | S26E/G117E/H365E | + |
| 1645/1646 | G117E/A164E/A707E | + |
| 1647/1648 | A165E/Q311E | ++ |
| 1649/1650 | G117E/Q311E/G332E | ++ |
| 1651/1652 | G117E/A213E/H365E/P517E | + |
| 1653/1654 | A253G/T519L | + |
| 1655/1656 | T519L/L563V | ++ |
| 1657/1658 | A253T/T519L | + |
| 1659/1660 | A253V/T519G | ++ |
| 1661/1662 | A253V/T519L | + |
| 1663/1664 | A253T/T519L/L563V | + |
| 1665/1666 | A253T/T519L/S635E | ++ |
| 1667/1668 | A253T/L563V/S635R | ++ |
| 1669/1670 | G157A/A253T/T519L | ++ |
| 1671/1672 | A253T/T519L/S635D | +++ |
| 1673/1674 | A122E/R550Q | + |
| 1675/1676 | A122D/R167E | + |
| 1677/1678 | F160W/L282M/Q381S/R550M | + |
| 1679/1680 | A122E/F1601/R167E/L282M/Q381H/R550Q/L636Q | ++ |
| 1681/1682 | A122D/F160M/L282M/R550S | + |
| 1683/1684 | F160M/T161Q/L282M/R550Q | ++ |
| 1685/1686 | A122D/R167E | + |
| 1687/1688 | L282M/R550Q | ++ |
| 1689/1690 | F160W/T161Q/L282M/R550M | +++ |
| 1691/1692 | F160M/L282M/R550M/L636Q | +++ |
| 1693/1694 | A122D/L282M/Q381S/R550M | +++ |
| 1695/1696 | A122D/R550M | +++ |
| 1697/1698 | A122D | +++ |
| 1699/1700 | A122E/L282M/R550Q | +++ |
| 1701/1702 | T161Q/L282M/R550Q/L636Q | +++ |
| 1703/1704 | A122E/F160M/T161Q/L282M/Q381S/R550M/L636Q | +++ |
| 1705/1706 | R167E/R550Q | ++ |
| 1707/1708 | A122D/L282M/R550Q | + |
| 1709/1710 | R167E/L282M/L636Q | + |
| 1711/1712 | L282M/Q381S/R550S | +++ |
| 1713/1714 | Q381S/R550S | + |
| 1715/1716 | T161Q/Q381S/R550Q | + |
| 1717/1718 | A122E/R167E/R550M | +++ |
| 1719/1720 | R550Q | ++ |
| 1721/1722 | F160M/T161Q/L282M/Q381S/R550M | ++ |
| 1723/1724 | A122E/F160W/Q381S/R550M/L636Q | + |
| 1725/1726 | F160M/L282M/Q381S/R550M | ++ |
| 1727/1728 | A122D/F160W/T161Q/L282M/R550Q | + |
| 1729/1730 | F160M/T161Q | +++ |
| 1731/1732 | Q381S/R550Q | + |
| 1733/1734 | A122E/F160W/Q381S/R550Q | ++ |
| 1735/1736 | A122D/F160W/T161Q/R167E/R550M | ++ |
| 1737/1738 | F160W/T161Q/L282M/R550Q | +++ |
| 1739/1740 | A122E/F160W/T161Q/R167E/R550S | ++ |
| 1741/1742 | A122D/F160W/R550M | + |
| 1743/1744 | F160W/T161Q/R550Q/L636Q/A735V | + |
| 1745/1746 | F160W/R167E/L282M/Q381S/L636Q | ++ |
| 1747/1748 | A122E/F160M/R550Q/L636Q | + |
| 1749/1750 | A122E/F160W/T161Q/L282M/Q381S/R550S | + |
| 1751/1752 | A122E/F160W/L282M/Q381S | + |
| 1753/1754 | A122D/F160W/L282M/Q381S/R550M | + |
| 1755/1756 | A122E/F160W/T161Q/R550M/L636Q | + |
| 1757/1758 | A122E/T161Q/R550Q | + |
| 1759/1760 | A122E/L282M/R550M/L636Q | ++ |
| 1761/1762 | A122E/Q381S/E706K | ++ |
| 1763/1764 | F160W/Q381S/R550Q/L636Q/A681V | +++ |
| 1765/1766 | R550M/L636Q | + |
| 1767/1768 | A122E/L282M/R550S | + |
| 1769/1770 | A122D/F160W/R550Q/L636Q | + |
| 1771/1772 | F160M/L282M | + |

[a]Levels of increased production were determined relative to the reference polypeptide of SEQ ID NO: 1582, and are defined as follows:
"+" = production at least that of the reference polypeptide, but less than 1.42-fold;
"++" = at least 1.42-fold, but less than 1.60-fold; and
"+++" = at least 1.60-fold increased production, relative to the reference polypeptide.

Shake Flask Powder Characterization Assay and Analysis for Glucosyl Transfer from Sucrose to Rebaudioside A An experiment was performed to characterize the activity of the engineered round 7 SUS variants on sucrose and ADP to facilitate the formation of rebaudioside D from rebaudioside A. Shake flask powder (SFP) was added to a 100 μL total reaction volume at 0.02 μL concentration containing 50 mM potassium phosphate buffer, pH6, 7.5 mM rebaudioside A97, 30 mM sucrose, 0.2 mM ADP, and 1 g/L GT SEQ ID NO: 2884. The reaction was performed at 50° C. in a Thermotron® titre-plate shaker with 300 RPM shaking for 1h. The reaction was solubilized by diluting 20× into water, quenched by adding 10 μL of the diluted reaction to 90 μL acetonitrile with 0.2% formic acid, and precipitated by centrifugation. The supernatant was diluted 4.4× in water and analyzed for steviol glycosides by RapidFire SPE-MS/MS, with the instrument and parameters described in Table 31.1. At least 3 of the variants had higher activities than SEQ ID NO: 1582. The levels of rebaudioside D produced from rebaudioside A by the variants relative to SEQ ID NO: 1582 are listed in Table 34.2. The variant with mutations F160W, Q381S, R550Q, L636Q, and A681V (SEQ ID NO:1764), relative to SEQ ID NO: 1582, was selected for further directed evolution for the catalysis of the recycling reaction transferring a glucose from sucrose to ADP.

TABLE 34.2

SUS Round 7 SFP Variants and RebD Levels

| SEQ ID NO: (nt/aa) | Amino Acid Differences (Relative to SEQ ID NO: 1582) | Increased RebD[a] |
|---|---|---|
| 1599/1600 | L562I | + |
| 1615/1616 | P517A/T640N | + |
| 1763/1764 | F160W/Q381S/R550Q/L636Q/A681V | + |

[a]Levels of increased production were determined relative to the reference polypeptide of SEQ ID NO: 1582, and are defined as follows:
"+" = production between 1.1- and 1.25-fold greater activity, as compared to the reference polypeptide.

Example 35

Sucrose Synthase Variants of SEQ ID NO: 1764

Directed evolution of the sucrose synthase encoded by SEQ ID NO: 1763 was continued by constructing libraries of variant genes in which mutations associated with improved activity in earlier rounds of evolution were recombined and in which certain structural features were subjected to saturation mutagenesis. These libraries were then plated, grown, and screened using the high-throughput (HTP) assay described below, to provide an eighth and ninth round ("Round 8" and "Round 9") of 24 engineered SuS variant polypeptides with activity toward the generation of ADP-glucose.

HTP Coupled Assay for Glucose Transfer from Sucrose to ADP to Rebaudioside A for Round 8

Combinatorial libraries were screened using the following HTP enzyme-coupled assay. Pelleted *E. coli* cultures were lysed with 400 μL of Tris-HCl, pH 7.5 with 1 mM magnesium sulfate and 0.5 mg/mL lysozyme and polymyxin B sulfate (PMBS), and cleared by centrifugation. Lysate was diluted 15× into Tris-HCl, pH 7.5. Then, 10 μL diluted SuS lysate and 1 g/L GT SEQ ID NO: 2884 (Rd9BB) were combined in 100 μL reaction volume with substrate loading of 15 mM rebaudioside A 97 and co-substrate loadings of 0.2 mM ADP (Sigma, >93%) and 45 mM sucrose (cane sugar). The following reaction conditions were used: 50 mM potassium phosphate buffer, pH 6, 55° C. in a Thermotron® titre-plate shaker with 300 RPM shaking for 2 h. The reaction described above was solubilized by adding 10 μL assay to 390 μL water, quenched by adding 20 μL solubilized assay to 180 μL acetonitrile with 0.2% formic acid, and precipitated by centrifugation. The supernatant was diluted 3.3× in water and steviol glycoside products were detected by RapidFire SPE-MS/MS, with the instrument and parameters described in Table 31.1. No substantially improved combinatorial variants were identified relative to SEQ ID NO: 1764, so another set of combinatorial and saturation mutagenesis libraries were generated using the same backbone, and this set was called "Round 9".

HTP Coupled Assay for Glucose Transfer from Sucrose to ADP to Rebaudioside A for Round 9

Combinatorial libraries were screened using the following HTP enzyme-coupled assay. Pelleted *E. coli* cultures were lysed with 400 μL of Tris-HCl, pH 7.5 with 1 mM magnesium sulfate and 0.5 mg/mL lysozyme and polymyxin B sulfate (PMBS), and cleared by centrifugation. Undiluted lysate (saturation mutagenesis library) or 32× (Round 9 combinatorial libraries) were added to Tris-HCl, pH 7.5. Round 9 library lysates were pre-incubated at 62° C. for 1 h (combinatorial libraries) or 3.75 h (saturation mutagenesis library) to thermally challenge the enzymes. Then, 10 μL diluted SuS lysate and 1 g/L GT SEQ ID NO: 3244 (Rd2B) were combined in 100 μL reaction volume with substrate loading of 15 mM rebaudioside A97, co-substrate loadings of 0.2 mM ADP (Sigma, >95%), 45 mM sucrose (cane sugar), and 9 mM fructose (Sigma). The following reaction conditions were used: 50 mM potassium phosphate buffer, pH 6, 60° C. in a Thermotron® titre-plate shaker with 300 RPM shaking for 2-3h. The reaction described above was solubilized by adding 10 μL assay to 390 μL water, quenched by adding 20 μL solubilized assay to 180 μL acetonitrile with 0.2% formic acid, and precipitated by centrifugation. The supernatant was diluted 3.3× in water and steviol glycoside products were detected by RapidFire SPE-MS/MS, with the instrument and parameters described in Table 31.1. After analysis, 24 engineered SuS variant polypeptides that showed improved activity coupled with a GT on rebaudioside A were identified. The resulting engineered polypeptides are listed in Table 35.1. Shake-flask scale cultures were grown for protein characterization as described in Example 31 for variants with the amino acid mutations shown in Table 35.2.

TABLE 35.1

SUS Round 9 Variants and RebD Levels

| SEQ ID NO: (nt/aa) | Amino Acid Differences (Relative to SEQ ID NO: 1764) | Increased RebD[a] |
|---|---|---|
| 1773/1774 | E536L | +++ |
| 1775/1776 | H705P | ++ |
| 1777/1778 | L580M | + |
| 1779/1780 | H699F | +++ |
| 1781/1782 | N347R/S532Y | +++ |
| 1783/1784 | H705M | + |
| 1785/1786 | A548P | ++ |
| 1787/1788 | V681A | +++ |
| 1789/1790 | L407I/R570H/V681A | + |
| 1791/1792 | V270L/V681A | ++ |
| 1793/1794 | G117E/A122D/V270L/L540M/V681A | + |
| 1795/1796 | L407T/V681A | ++ |
| 1797/1798 | E536L/H705M | + |
| 1799/1800 | A548P/L580M | + |
| 1801/1802 | N347R/E536L/A548P/H705P | ++ |
| 1803/1804 | G181N/A548P/H705P | +++ |

TABLE 35.1-continued

SUS Round 9 Variants and RebD Levels

| SEQ ID NO: (nt/aa) | Amino Acid Differences (Relative to SEQ ID NO: 1764) | Increased RebD[a] |
|---|---|---|
| 1805/1806 | A631/E536L | + |
| 1807/1808 | A548P/H705P | + |
| 1809/1810 | L580M | + |
| 1811/1812 | E536L/A548P/H699F | + |
| 1813/1814 | G181N/E536L/A548P/H705M | + |
| 1815/1816 | G181N/E536L/A548P | ++ |
| 1817/1818 | E536L/A548P | + |
| 1819/1820 | E536L | ++ |

[a]Levels of increased production were determined relative to the reference polypeptide of SEQ ID NO: 1764, and are defined as follows:
"+" = production at least 1.5-fold, but less than 2.4-fold;
"++" = at least 2.4-fold, but less than 3.0-fold; and
"+++" = at least 3.0-fold increased production, relative to the reference polypeptide.

Shake Flask Powder Characterization Assay and Analysis for Glucosyl Transfer from Sucrose to Rebaudioside A An experiment was performed to characterize the activity of the engineered round 9 SUS variants on sucrose and ADP to facilitate the formation of rebaudioside D from rebaudioside A. Shake flask powder (SFP) was added to a 100 μL total reaction volume at 0.006-0.2 μL concentration containing 50 mM potassium phosphate buffer, pH6, 15 mM rebaudioside A (>97% purity), 45 mM sucrose, 9 mM fructose, 0.2 mM ADP, and 1 g/L GT SEQ ID NO: 3244. The reaction was performed at 50° C. in a Thermotron® titre-plate shaker with 300 RPM shaking for 2 h without pre-incubation, or the SFP was pre-incubated at 10× final concentration in pH 6 potassium phosphate buffer at 62° C. for 1 h prior to 60° C. reaction for 2h. The reaction was solubilized by diluting 40× into water, quenched by diluting 10× into acetonitrile with 0.2% formic acid, and precipitated by centrifugation. The supernatant was diluted 3.3× in water and analyzed for steviol glycosides by RapidFire SPE-MS/MS, with the instrument and parameters described in Table 31.1. All 8 of the variants listed in Table 35.2 had higher activities than SEQ ID NO: 1764. The variant with the mutations G181N, A548P, H705P (SEQ ID NO: 1804), relative to SEQ ID NO: 1764, had the most beneficial mutations and was selected for further directed evolution for the catalysis of the recycling reaction transferring a glucosyl from sucrose to ADP.

TABLE 35.2

SUS Round 9 SFP Variants and RebD Levels

| SEQ ID NO: (nt/aa) | Amino Acid Differences (Relative to SEQ ID NO: 1764) | Increased RebD, 50° C.[a] | Increased RebD, 60° C.[a] |
|---|---|---|---|
| 1787/1788 | V681A | ++ | +++ |
| 1791/1792 | V270L/V681A | ++ | +++ |
| 1793/1794 | G117E/A122D/V270L/L540M/V681A | + | + |
| 1795/1796 | L407T/V681A | + | +++ |
| 1803/1804 | G181N/A548P/H705P | ++ | +++ |
| 1807/1808 | A548P/H705P | ++ | +++ |
| 1809/1810 | L580M | + | + |
| 1815/1816 | G181N/E536L/A548P | + | +++ |

[a]Levels of increased production were determined relative to the reference polypeptide of SEQ ID NO: 1764, and are defined as follows:
"+" = production at least 1.1-fold, but less than 1.7-fold;
"++" = production at least 1.7-fold, but less than 2.3-fold; and
"+++" = production at least 2.3-fold greater, as compared to the reference polypeptide.

Example 36

Sucrose Synthase Variants of SEQ ID NO: 1804

Directed evolution of the sucrose synthase encoded by SEQ ID NO: 1803 was continued by constructing libraries of variant genes in which mutations associated with improved activity in earlier rounds of evolution were recombined and in which certain structural features were subjected to saturation mutagenesis. These libraries were then plated, grown, and screened using the high-throughput (HTP) assay described below, to provide a tenth round ("Round 10") of 82 engineered SuS variant polypeptides with increased activity toward the generation of ADP-glucose.

HTP Coupled Assay for Glucose Transfer from Sucrose to ADP to Rebaudioside A

Libraries were screened using the following HTP enzyme-coupled assay. Pelleted *E. coli* cultures were lysed with 400 μL of Tris-HCl, pH 7.5, with 1 mM magnesium sulfate and 0.5 mg/mL lysozyme and polymyxin B sulfate (PMBS) and cleared by centrifugation. Lysate was diluted 20× into potassium phosphate buffer, pH 6.0, and pre-incubated for 15 minutes at 64° C. (combinatorial libraries) or 65° C. (saturation mutagenesis library). Then, 10 μL diluted SuS lysate and 0.5-1 g/L GT SEQ ID NO: 3696 or 3502, respectively, were used in 100 μL reaction volume with 15 mM rebaudioside A (>97% purity), 0.2 mM ADP (Sigma, >93%), 45 mM sucrose (cane sugar), and 9 mM fructose. The following reaction conditions were used: 50 mM potassium phosphate buffer, pH 6, 60° C. in a Thermotron® titre-plate shaker with 300 RPM shaking for 3 h. The reaction described above was solubilized by diluting 40× in water, quenched by diluting 10× in acetonitrile with 0.2% formic acid, and precipitated by centrifugation. The supernatant was diluted 3.3× in water and steviol glycoside products were detected by RapidFire SPE-MS/MS, with the instrument and parameters described in Table 31.1. After analysis, the engineered SuS variant polypeptides that showed improved activity coupled with a GT on rebaudioside A were identified and are listed in Table 36.1. Shake-flask scale cultures were grown for protein characterization as described in Example 31 for variants with the amino acid mutations shown in Table 36.2.

TABLE 36.1

SUS Round 10 Variants and RebD Levels

| SEQ ID NO: (nt/aa) | Amino Acid Differences (Relative to SEQ ID NO: 1804) | Increased RebD[a] |
|---|---|---|
| 1821/1822 | N347R/Q550I/V681A | + |
| 1823/1824 | N347R/S532Y/Q550I/T640N/V681A/H699F | + |
| 1825/1826 | N347R/V681A | + |
| 1827/1828 | N347R/Y434H/P517A/L562I/T640N/V681A | + |
| 1829/1830 | N347R/P517A/S532Y/V681A | + |
| 1831/1832 | N347R/Y434H/V681A | + |
| 1833/1834 | E536L/L580M/V681A | + |
| 1835/1836 | N347R/Q550I/L580M/V681A | + |
| 1837/1838 | N347R/E536L/L562I/V681A | + |
| 1839/1840 | P517A/V681A | + |
| 1841/1842 | S532Y/V681A | + |
| 1843/1844 | Y434H/P517A/S532Y/V681A | + |
| 1845/1846 | N347R/Y434H/S532Y/L562I/T640N/V681A | + |
| 1847/1848 | L562I/V681A | + |
| 1849/1850 | N347R/Y434H/Q550I/L562I/V681A | + |
| 1851/1852 | A389G | ++ |
| 1853/1854 | S539A | +++ |
| 1855/1856 | L433K | ++ |
| 1857/1858 | R71Q | +++ |
| 1859/1860 | E87L | ++ |
| 1861/1862 | P13K | ++ |

TABLE 36.1-continued

SUS Round 10 Variants and RebD Levels

| SEQ ID NO: (nt/aa) | Amino Acid Differences (Relative to SEQ ID NO: 1804) | Increased RebD[a] |
|---|---|---|
| 1863/1864 | D765A | ++ |
| 1865/1866 | Q37R | ++ |
| 1867/1868 | R90H | ++ |
| 1869/1870 | D60L | + |
| 1871/1872 | S531T | ++ |
| 1873/1874 | Q37G | + |
| 1875/1876 | S539R | +++ |
| 1877/1878 | D17R | +++ |
| 1879/1880 | P535S | + |
| 1881/1882 | R606H | ++ |
| 1883/1884 | V98L | + |
| 1885/1886 | L388K | ++ |
| 1887/1888 | P57W | +++ |
| 1889/1890 | P535H | + |
| 1891/1892 | P13H | + |
| 1893/1894 | E727K | + |
| 1895/1896 | V85H | + |
| 1897/1898 | R606A | ++ |
| 1899/1900 | A789R | + |
| 1901/1902 | A789N | + |
| 1903/1904 | A18G | + |
| 1905/1906 | P13N | + |
| 1907/1908 | K415H | + |
| 1909/1910 | S531R | +++ |
| 1911/1912 | R711K | +++ |
| 1913/1914 | R606Q | ++ |
| 1915/1916 | R606L | + |
| 1917/1918 | R606M | ++ |
| 1919/1920 | R606I | + |
| 1921/1922 | D52P | +++ |
| 1923/1924 | D52W | + |
| 1925/1926 | S30H | + |
| 1927/1928 | E87H | ++ |
| 1929/1930 | A118N | ++ |
| 1931/1932 | Q769K | +++ |
| 1933/1934 | E129G | +++ |
| 1935/1936 | D52R | ++ |
| 1937/1938 | E99I | + |
| 1939/1940 | E129A | + |
| 1941/1942 | L433P | ++ |
| 1943/1944 | E748T | + |
| 1945/1946 | A164T | + |
| 1947/1948 | A707G | ++ |
| 1949/1950 | P57R | ++ |
| 1951/1952 | A608P | ++ |
| 1953/1954 | A118G | + |
| 1955/1956 | P535A | + |
| 1957/1958 | D180P | + |
| 1959/1960 | Q769R | + |
| 1961/1962 | N183P | +++ |
| 1963/1964 | R71G | ++ |
| 1965/1966 | R606V | ++ |
| 1967/1968 | E129T | +++ |
| 1969/1970 | A164S | ++ |
| 1971/1972 | L388R | ++ |
| 1973/1974 | H365W | + |
| 1975/1976 | D52G | +++ |
| 1977/1978 | G589S | +++ |
| 1979/1980 | E738S | +++ |
| 1981/1982 | D765S | +++ |
| 1983/1984 | S531A | ++ |

[a]Levels of increased production were determined relative to the reference polypeptide of SEQ ID NO: 1804, and are defined as follows:
"+" = production at least 1.3-fold, but less than 2-fold;
"++" = at least 2-fold, but less than 2.36-fold; and
"+++" = at least 2.36-fold increased production, relative to the reference polypeptide.

Shake Flask Powder Characterization Assay and Analysis for Glucosyl Transfer from Sucrose to Rebaudioside A An experiment was performed to characterize the activity of the engineered round 10 SUS variants on sucrose and ADP to facilitate the formation of rebaudioside D from rebaudioside A. Shake flask powder (SFP) was made up to 0.06-2 g/L in potassium phosphate buffer, pH6, and an aliquot was pre-incubated at 64° C. in a thermocycler for 15 minutes. Then, 10 μL of these SFP dilutions, either pre-incubated or not pre-incubated, were added to a 100 μL total reaction volume containing 50 mM potassium phosphate buffer, pH 6, 15 mM rebaudioside A (>97% purity), 45 mM sucrose, 9 mM fructose, 0.2 m ADP, and g/L GT SEQ ID NO:3696. The reactions were performed at 55° C. for SFP samples that were not pre-incubated and at 60° C. for pre-incubated SFP in a Thermotron® titre-plate shaker with 300 RPM shaking for 3h. The reaction was solubilized by diluting 40× into water, quenched by diluting 10× into acetonitrile with 0.2% formic acid, and precipitated by centrifugation. The supernatant was diluted 3.3× in water and analyzed for steviol glycosides by RapidFire SPE-MS/MS, with the instrument and parameters described in Table 31.1. All 7 of the variants listed in Table 36.2 had higher activities than SEQ ID NO: 1804 under the pre-incubated condition, and all but one also had higher activity under the 55° C. condition. The variant with the mutations P517A and V681A (SEQ ID NO: 1840) was the most improved under both conditions relative to SEQ ID NO: 1804, so it was selected for further directed evolution for the catalysis of the recycling reaction transferring a glucose from sucrose to ADP.

TABLE 36.2

SUS Round 10 SFP Variants and RebD Levels

| SEQ ID NO: (nt/aa) | Amino Acid Differences (Relative to SEQ ID NO: 1804) | Increased RebD 55° C.[a] | Increased RebD 60° C.[a] |
|---|---|---|---|
| 1821/1822 | N347R/Q550I/V681A | + | ++ |
| 1823/1824 | N347R/S532Y/Q550I/T640N/V681A/H699F | − | + |
| 1827/1828 | N347R/Y434H/P517A/L562I/T640N/V681A | + | ++ |
| 1831/1832 | N347R/Y434H/V681A | + | ++ |
| 1837/1838 | N347R/E536L/L562I/V681A | + | ++ |
| 1839/1840 | P517A/V681A | ++ | +++ |
| 1845/1846 | N347R/Y434H/S532Y/L562I/T640N/V681A | + | ++ |

[a]Levels of increased production were determined relative to the reference polypeptide of SEQ ID NO: 1804, and are defined as follows:
"−" = production less than that of the reference polypeptide;
"+" = production at least that of the reference polypeptide, but less than 1.5-fold;
"++" = production at least 1.5-fold, but less than 2-fold; and
"+++" = production at least 2-fold greater, as compared to the reference polypeptide.

Example 37

Sucrose Synthase Variants of SEQ ID NO: 1840

Directed evolution of the sucrose synthase encoded by SEQ ID NO: 1839 was continued by constructing libraries of variant genes in which mutations associated with improved activity in earlier rounds of evolution were recombined and in which certain structural features were subjected to saturation mutagenesis. These libraries were then plated, grown, and screened using the high-throughput (HTP) assay described below, to provide an eleventh round ("Round 11") of 167 engineered SuS variant polypeptides with increased activity toward the generation of ADP-glucose.

HTP Coupled Assay for Glucose Transfer from Sucrose to ADP to Rebaudioside A

Libraries were screened using the following HTP enzyme-coupled assay. Pelleted E. coli cultures were lysed with 400 μL of Tris-HCl, pH 7.5, with 1 mM magnesium sulfate and 0.5 mg/mL lysozyme and polymyxin B sulfate (PMBS), and cleared by centrifugation. Lysate was diluted 10-20× into potassium phosphate buffer, pH 6.0, and pre-incubated for 15 minutes at 66° C. Then, 10 μL diluted, pre-incubated SuS lysate and 0.5 g/L GT SEQ ID NO: 3696 or 3956, were used in 100 μL reaction volume with 15 mM rebaudioside A (>97% purity), 0.2 mM ADP (Amresco, >93%), 45 mM sucrose (cane sugar), and 9 mM fructose. The following reaction conditions were used: 50 mM potassium phosphate buffer, pH 6, 60° C., in a Thermotron® titre-plate shaker with 300 RPM shaking for 4 h. The reaction described above was solubilized by diluting 40× in water, quenched by diluting 5-10× in acetonitrile with 0.2% formic acid, and precipitated by centrifugation. The supernatant was diluted in water to ~10 μM steviol glycosides and steviol glycoside products were detected by RapidFire SPE-MS/MS with the instrument and parameters described in Table 31.1. After analysis, the engineered SuS variant polypeptides that showed improved activity coupled with a GT on rebaudioside A were identified and are listed in Tables 37.1 and 37.2. Shake-flask scale cultures were grown for protein characterization as described in Example 31 for variants with the amino acid mutations shown in Table 37.3.

TABLE 37.1

SUS Round 11 Combinatorial Variants and RebD Levels

| SEQ ID NO: (nt/aa) | Amino Acid Differences (Relative to SEQ ID NO: 1840) | Increased RebD$^a$ |
|---|---|---|
| 1985/1986 | D17R/E129T/G589S | + |
| 1987/1988 | D17R/G589S/E738S | ++ |
| 1989/1990 | D17R/E129T/G589S/E738S | + |
| 1991/1992 | D17R/E129T/G589S/E738S/D765S | +++ |
| 1993/1994 | D52P/E129T/G589S/E738S/D765S | +++ |
| 1995/1996 | D52P/E129T/E738S | + |
| 1997/1998 | D52P/A118N/E129T/D765S | + |
| 1999/2000 | D17R/D52P/E87H/G589S/E738S/D765S | +++ |
| 2001/2002 | E87H/E129T/L388K/G589S | + |
| 2003/2004 | D17R/D52G/E129T/R653H/E738S/D765S | + |
| 2005/2006 | D17R/E738S/D765S | + |
| 2007/2008 | D17R/D52G/E87H/E129T/L388K/G589S/E738S | ++ |
| 2009/2010 | D17R/L388K/G589S/E738S | ++ |
| 2011/2012 | D17R/D52P/E129T/E738S | ++ |
| 2013/2014 | D17R/D52P/E129T/G589S/D765S | ++ |
| 2015/2016 | D17R/D52P/E87H/E129G/L388K/G589S | +++ |
| 2017/2018 | D52G/A118N/L388K/G589S/E738S | +++ |
| 2019/2020 | D52P/E87H/A118N/E129T/L388K/D765S | ++ |
| 2021/2022 | D52G/G84A/E129T/L388K/E738S/D765S | + |
| 2023/2024 | D17R/D52P/A118N/E129T/S265T/G589S/D765S | ++ |
| 2025/2026 | D17R/D52P/A118N/L388K/G589S/E738S/D765S | +++ |
| 2027/2028 | D17R/D52G/E129G/G589S/E738S | + |
| 2029/2030 | D17R/D52G/E129T/L388K/G589S/E738S | +++ |
| 2031/2032 | D17R/E87H/A118N/L388K/E738S | + |
| 2033/2034 | D52G/L388K/E738S/D765S | + |
| 2035/2036 | D17R/D52G/A118N/L388K/E738S/D765S | + |
| 2037/2038 | D17R/D52P/E129G/E738S/D765S | + |
| 2039/2040 | D17R/D52P/E87H/A118N/E129T/G589S/E738S/D765S | + |
| 2041/2042 | D52P/E87H/A118N/L388K/G589S/E738S | ++ |
| 2043/2044 | G84A/E129T/G589S/E738S/D765S | + |
| 2045/2046 | D17R/D52G/G589S/D765S | + |
| 2047/2048 | D17R/D52P/G589S/E738S/D765S | +++ |
| 2049/2050 | D17R/D52G/E87H/E129T/E738S | + |
| 2051/2052 | D17R/D52G/E87H/A118N/E129T/G589S/D765S | ++ |
| 2053/2054 | D17R/D52P/A118N/E129T/G589S/E738S/D765S | ++ |
| 2055/2056 | D52G/E87H/E738S | + |
| 2057/2058 | D17R/D52G/E87H/A118N/E129G/G589S/E738S | + |
| 2059/2060 | D17R/D52P/E129G/L388K/G589S/E738S/D765S | ++ |
| 2061/2062 | D17R/D52P/E87H/A118N/E129T/L388K/G589S/E738S/D765S | + |
| 2063/2064 | D17R/D52P/L388K/G589S/E738S/D765S | ++ |
| 2065/2066 | D17R/D52P/E87H/E129T/L388K/G589S/E738S | + |
| 2067/2068 | D52G/E87H/E129T/L388K/E738S/D765S | + |
| 2069/2070 | D17R/D52G/E87H/L388K/G589S/D765S | + |
| 2071/2072 | D17R/D52P/A118N/L388K/G589S/E738S | ++ |
| 2073/2074 | D17R/G589S/D765S | + |
| 2075/2076 | D52G/E87H/A118N/G589S/E738S/D765S | ++ |
| 2077/2078 | D52G/E738S/D765S | + |
| 2079/2080 | D52P/G589S/E738S/D765S | ++ |
| 2081/2082 | D52P/E87H/E129G/D765S | +++ |
| 2083/2084 | D17R/E129T/E738S/D765S | ++ |
| 2085/2086 | D17R/D52P/L388K/G589S/E738S | +++ |
| 2087/2088 | D17R/A118N/E129T/L388K/E738S/D765S | + |
| 2089/2090 | D52P/A118N/E129T/G589S/E738S | ++ |
| 2091/2092 | D52G/A118N/L388K/E738S/D765S | + |
| 2093/2094 | G589S/E738S/D765S | ++ |
| 2095/2096 | D17R/D52G/A118N/E129T/L388K/G589S/E738S/D765S | ++ |
| 2097/2098 | D52P/E129G/G589S/D765S | + |
| 2099/2100 | D52P/G589S/E738S | +++ |
| 2101/2102 | D52P/G589S/E738S/D765S | +++ |
| 2103/2104 | D52P/E87H/G589S/E738S | +++ |

TABLE 37.1-continued

SUS Round 11 Combinatorial Variants and RebD Levels

| SEQ ID NO: (nt/aa) | Amino Acid Differences (Relative to SEQ ID NO: 1840) | Increased RebD[a] |
|---|---|---|
| 2105/2106 | D17R/D52P/A118N/E129T/E738S/D765S | + |
| 2107/2108 | D17R/D52G/E129T/G589S | + |
| 2109/2110 | D17R/E87H/E129T/L388K/E738S | + |
| 2111/2112 | E87H/A118N/E129T/D765S | + |

[a]Levels of increased production were determined relative to the reference polypeptide of SEQ ID NO: 1840, and defined as follows:
"+" = production at least 11-fold, but less than 14.9-fold;
"++" = at least 14.9-fold, but less than 18.3-fold; and
"+++" = at least 18.3-fold increased production, relative to the reference polypeptide.

TABLE 37.2

SUS Round 11 Saturation Mutagenesis Variants and RebD Levels

| SEQ ID NO: (nt/aa) | Amino Acid Differences (Relative to SEQ ID NO: 1840) | Increased RebD[a] |
|---|---|---|
| 2113/2114 | R14K | ++ |
| 2115/2116 | I480V | ++ |
| 2117/2118 | M263Y | ++ |
| 2119/2120 | D218V | + |
| 2121/2122 | H154A | +++ |
| 2123/2124 | G360R | + |
| 2125/2126 | E534W/E739K | +++ |
| 2127/2128 | G603H | + |
| 2129/2130 | E59N/D72N | ++ |
| 2131/2132 | Q33S | + |
| 2133/2134 | V134P | ++ |
| 2135/2136 | P81I | +++ |
| 2137/2138 | S393H | ++ |
| 2139/2140 | V134A | ++ |
| 2141/2142 | E390M | + |
| 2143/2144 | P364S | + |
| 2145/2146 | Y434R | + |
| 2147/2148 | W212Y | + |
| 2149/2150 | S15I | + |
| 2151/2152 | V316T | + |
| 2153/2154 | P530F | +++ |
| 2155/2156 | H92G | + |
| 2157/2158 | S175G | +++ |
| 2159/2160 | G652L | +++ |
| 2161/2162 | E534R | +++ |
| 2163/2164 | G603S | +++ |
| 2165/2166 | S26I | + |
| 2167/2168 | H154R | + |
| 2169/2170 | E105S | + |
| 2171/2172 | E59R | + |
| 2173/2174 | D130Y | +++ |
| 2175/2176 | F542W | ++ |
| 2177/2178 | S26E | + |
| 2179/2180 | S15P | + |
| 2181/2182 | W79Y | ++ |
| 2183/2184 | P81L | +++ |
| 2185/2186 | A165L | + |
| 2187/2188 | P81G | ++ |
| 2189/2190 | I362E | + |
| 2191/2192 | G603A | ++ |
| 2193/2194 | E534W | +++ |
| 2195/2196 | G652S | ++ |
| 2197/2198 | D218T | ++ |
| 2199/2200 | D218A | ++ |
| 2201/2202 | L20M | + |
| 2203/2204 | R319S | + |
| 2205/2206 | S15A | + |
| 2207/2208 | E59W | + |
| 2209/2210 | E59S | + |
| 2211/2212 | G652T | +++ |
| 2213/2214 | L241T | ++ |
| 2215/2216 | D218N | ++ |
| 2217/2218 | H154E | + |
| 2219/2220 | Y434G | ++ |
| 2221/2222 | Q46V | + |
| 2223/2224 | Q46R | + |
| 2225/2226 | W79H | ++ |
| 2227/2228 | G652K | +++ |
| 2229/2230 | Q33H/H154C | +++ |
| 2231/2232 | M263S | + |
| 2233/2234 | A165I | + |
| 2235/2236 | V93T | + |
| 2237/2238 | G603E | +++ |
| 2239/2240 | Q349R | ++ |
| 2241/2242 | I480P | ++ |
| 2243/2244 | E534L | +++ |
| 2245/2246 | E534G | +++ |
| 2247/2248 | E59C | + |
| 2249/2250 | A213V | + |
| 2251/2252 | Q33P | + |
| 2253/2254 | Q46T | + |
| 2255/2256 | E534K | +++ |
| 2257/2258 | E59A | ++ |
| 2259/2260 | Q46I | + |
| 2261/2262 | L58M | + |
| 2263/2264 | E534T | +++ |
| 2265/2266 | G50R | + |
| 2267/2268 | G652R | +++ |
| 2269/2270 | S256G | ++ |
| 2271/2272 | A97V/H154S | ++ |
| 2273/2274 | V316H | ++ |
| 2275/2276 | V24S | + |
| 2277/2278 | G360E | + |
| 2279/2280 | E498Q | + |
| 2281/2282 | G360D | + |
| 2283/2284 | Q349T | ++ |
| 2285/2286 | S175T | + |
| 2287/2288 | G603Q | ++ |
| 2289/2290 | A18V/I362A | ++ |
| 2291/2292 | H154S | + |
| 2293/2294 | D104T | + |
| 2295/2296 | S26A | ++ |
| 2297/2298 | Q46G | + |
| 2299/2300 | Q33L | + |
| 2301/2302 | D218S | ++ |
| 2303/2304 | A165T | + |
| 2305/2306 | Q349D | + |
| 2307/2308 | D54M | + |
| 2309/2310 | S26T | + |
| 2311/2312 | E498L | + |
| 2313/2314 | M185L | + |
| 2315/2316 | D218Q | ++ |
| 2317/2318 | E59V | ++ |

[a]Levels of increased production were determined relative to the reference polypeptide of SEQ ID NO: 1840, and defined as follows:
"+" = production at least 1.2-fold, but less than 1.62-fold;
"++" = at least 1.62-fold, but less than 2.4-fold; and
"+++" = at least 2.4-fold increased production, relative to the reference polypeptide.

Shake Flask Powder Characterization Assay and Analysis for Glucosyl Transfer from Sucrose to Rebaudioside A An experiment was performed to characterize the activity of the engineered round 11 SUS variants on sucrose and ADP to facilitate the formation of rebaudioside D from rebaudioside A. Shake flask powder (SFP) was made up to 0.03-1 g/L in potassium phosphate buffer, pH 6, and an aliquot was pre-incubated at 66° C. in a thermocycler for 15 minutes. Then, 10 µL of these SFP dilutions, either pre-incubated or not pre-incubated, were added to a 100 µL total reaction volume containing 50 mM potassium phosphate buffer, pH 6, 15 mM rebaudioside A (>97% purity), 45 mM sucrose, 9 mM fructose, 0.2 mM ADP, and 0.5 g/L GT SEQ ID NO: 3956. The reactions were performed at 55° C. for SFP samples that were not pre-incubated and at 60° C. for pre-incubated SFP in a Thermotron® titre-plate shaker with 300 RPM shaking for 4 h. The reaction was solubilized by diluting 40× into water, quenched by diluting 10× into acetonitrile with 0.2% formic acid, and precipitated by centrifugation. The supernatant was diluted 3.3× in water and analyzed for steviol glycosides by RapidFire SPE-MS/MS with the instrument and parameters described in Table 31.1. All 8 of the variants listed in Table 37.3 had higher activities than SEQ ID NO: 1840 under the pre-incubated condition, and all but three also had higher activity under the 55° C. condition. The variant with the mutations D17R, D52P, L388K, G589S, E738S, and D765S (SEQ ID NO: 2064), which was improved under both conditions relative to SEQ ID NO: 1840, was selected for further directed evolution for the catalysis of the recycling reaction transferring a glucose from sucrose to ADP.

TABLE 37.3

SUS Round 11 SFP Variants and RebD Levels

| SEQ ID NO: (nt/aa) | Amino Acid Differences (Relative to SEQ ID NO: 1840) | Increased RebD, 55° C.[a] | Increased RebD, 60° C.[a] |
|---|---|---|---|
| 1999/2000 | D17R/D52P/E87H/G589S/E738S/D765S | − | ++ |
| 2017/2018 | D52G/A118N/L388K/G589S/E738S | − | ++ |
| 2025/2026 | D17R/D52P/A118N/L388K/G589S/E738S/D765S | − | ++ |
| 2047/2048 | D17R/D52P/G589S/E738S/D765S | + | +++ |
| 2059/2060 | D17R/D52P/E129G/L388K/G589S/E738S/D765S | + | +++ |
| 2063/2064 | D17R/D52P/L388K/G589S/E738S/D765S | + | +++ |
| 2099/2100 | D52P/G589S/E738S | + | ++ |
| 2103/2104 | D52P/E87H/G589S/E738S | + | ++ |

[a]Levels of increased production were determined relative to the reference polypeptide of SEQ ID NO: 1840, and defined as follows:
"−" = production less than that of the reference polypeptide;
"+" = production at least that of the reference polypeptide, but less than 2-fold;
"++" = production at least 2-fold, but less than 3.2-fold; and
"+++" = production at least 3.2-fold greater than that of the reference polypeptide.

Example 38

Sucrose Synthase Variants of SEQ ID NO: 2064

Directed evolution of the sucrose synthase encoded by SEQ ID NO: 2063, was continued by constructing libraries of variant genes in which mutations associated with improved activity in earlier rounds of evolution were recombined and in which certain structural features were subjected to saturation mutagenesis. These libraries were then plated, grown, and screened using the high-throughput (HTP) assay described below, to provide a twelfth round ("Round 12") of 92 engineered SuS variant polypeptides with increased activity toward the generation of ADP-glucose.

HTP Coupled Assay for Glucose Transfer from Sucrose to ADP to Rebaudioside A

Libraries were screened using the following HTP enzyme-coupled assay. Pelleted *E. coli* cultures were lysed with 400 µL of Tris-HC, pH 7.5, with 1 mM magnesium sulfate and 0.5 mg/mL lysozyme and polymyxin B sulfate (PMBS), and cleared by centrifugation. Lysate was diluted 10× into potassium phosphate buffer, pH 6.0, and pre-incubated for 15 minutes at 68° C. Then, 10 µL diluted, pre-incubated SuS lysate and 0.5 g/L GT SEQ ID NO: 3956 or 4256 were used in 100 µL reaction volume with 15 mM rebaudioside A (>97% purity), 0.2 mM ADP (Amresco, >93%), 37.5 mM sucrose (cane sugar), and 9 mM fructose. The following reaction conditions were used: 50 mM potassium phosphate buffer, pH 6, 60° C. in a Thermotron® titre-plate shaker with 300 RPM shaking for 4h. The reaction described above was solubilized by diluting 40× in water, quenched by diluting 5× in acetonitrile with 0.2% formic acid, and precipitated by centrifugation. The supernatant was diluted 7.5× in water and steviol glycoside products were detected by RapidFire SPE-MS/MS with the instrument and parameters described in Table 31.1. After analysis, the engineered SuS variant polypeptides that showed improved activity coupled with a GT on rebaudioside A were identified and are listed in Tables 38.1 and 38.2. Shake-flask scale cultures were grown for protein characterization as described in Example 31 for variants with the amino acid mutations shown in Table 38.3.

TABLE 38.1

SUS Round 12 Combinatorial Variants and RebD Levels

| SEQ ID NO: (nt/aa) | Amino Acid Differences (Relative to SEQ ID NO: 2064) | Increased RebD[a] |
|---|---|---|
| 2319/2320 | P57W/S531R/S532Y/E536L/L562I | ++ |
| 2321/2322 | E129T/Q550I/L562I | + |
| 2323/2324 | R71Q/E129T/D180P/Y434H/S532Y/E536L/S539R/R711K/A789N | + |
| 2325/2326 | E87H/N347R/E536L/S539R/Q550I | + |
| 2327/2328 | P57W/N347R/Y434H/S531R/S532Y/S539R/A789N | + |
| 2329/2330 | P57W/E129G/E536L/R606M/A789N | + |
| 2331/2332 | R71Q/E129T/R606M | + |
| 2333/2334 | N347R/S531R/Q550I/R711K | ++ |
| 2335/2336 | P57W/E87H/N347R/L562I | + |
| 2337/2338 | N347R/E536L/L562I/R606M/E612A | + |

TABLE 38.1-continued

SUS Round 12 Combinatorial Variants and RebD Levels

| SEQ ID NO: (nt/aa) | Amino Acid Differences (Relative to SEQ ID NO: 2064) | Increased RebD[a] |
|---|---|---|
| 2339/2340 | E129T/E536L/S539R/L562I | + |
| 2341/2342 | S531R/S532Y/E536L/Q550I/L562I/R606M/A789N | + |
| 2343/2344 | E129T/D180P/Y434H/L562I/R711K/A789N | + |
| 2345/2346 | P57W/R90H/E129G/L562I | + |
| 2347/2348 | P57W/R71Q/E129G/S531R/S532Y/E536L/S539R/R606H | ++ |
| 2349/2350 | R90H/E129T/S539R/Q550I/R606H | + |
| 2351/2352 | R71Q/E129T/S531R | + |
| 2353/2354 | P57W/L562I/R606M/R711K | ++ |
| 2355/2356 | Y434H/S531R/S539R/Q550I/L562I/R711K | + |
| 2357/2358 | P57W/E129G/S531R/S539R/L562I/A789N | + |
| 2359/2360 | P57W/E129T/N347R/E536L/Q550I/L5621/R711K/A789N | + |
| 2361/2362 | P57W/E129T/R606M | + |
| 2363/2364 | E129T/D180P/R606M/R711K/A789N | + |
| 2365/2366 | P57W/R90H/E129T/L562I/R711K | ++ |
| 2367/2368 | E129G/Q550I | + |
| 2369/2370 | P57W/R71Q/L562I/R606M/R711K/A789N | + |
| 2371/2372 | E87H/G189D/S532Y/E536L/L5621/R711K/A789N | + |
| 2373/2374 | L5621/R711K | ++ |
| 2375/2376 | P57W/R71Q/E129T/D180P/Y434H/E536L/L562I | ++ |
| 2377/2378 | P57W/R71Q/E87H/N347R/Y434H/L562I/R606H | +++ |
| 2379/2380 | R71Q/E536L/S539R/L562I | +++ |
| 2381/2382 | P57W/E129T/N347R/Q550I/R711K | ++ |
| 2383/2384 | P57W/L96Q/E129T/D180P/S531R/S532Y/Q550I/L562I | ++ |
| 2385/2386 | E87H/N347R/S531R/R606M/A789N | + |
| 2387/2388 | D180P/S532Y | + |
| 2389/2390 | S531R/S532Y/E536L/S539R/L562I/R711K/A789N | +++ |
| 2391/2392 | R71Q/N347R/S532Y/Q550I/L562I/R711K | +++ |
| 2393/2394 | P57W/D180P/L5621/R606H/E612A | + |
| 2395/2396 | P57W/R71Q/A789N | + |
| 2397/2398 | P57W/Y434H/Q550I/L562I/R606H/E612A/A789N | ++ |
| 2399/2400 | P57W/E87H/D180P/S531R/S532Y/L562I/R606M/E612A/R711K | ++ |
| 2401/2402 | S531R/S532Y/L562I/R606M/R711K | ++ |
| 2403/2404 | E129G/L562I/R606M/R711K | +++ |
| 2405/2406 | P57W/R71Q/E129T/Y434H/S531R/E536L/L562I | +++ |
| 2407/2408 | N347R/Q550I/L562I/R606H | +++ |
| 2409/2410 | E129T/N347R/L562I | ++ |
| 2411/2412 | P57W/D180P/L562I | ++ |
| 2413/2414 | E129T/S539R/L562I/A789N | ++ |
| 2415/2416 | N347R/E536L/S539R/Q550I/R711K/A789N | ++ |
| 2417/2418 | D180P/Q550I/R606M | +++ |
| 2419/2420 | Y434H/Q550I | +++ |
| 2421/2422 | P57W/E129T/N347R/S531R/S532Y/S539R/L5621/R711K/A747V | + |
| 2423/2424 | R71Q/N347R/E536L/L562I/E612A/A789N | ++ |
| 2425/2426 | R71Q/E129T/D180P/N347R/S531R/S539R/Q550I | + |
| 2427/2428 | S532Y/S539R/Q550I | +++ |
| 2429/2430 | E129G/Q550I/L562I | +++ |
| 2431/2432 | P57W/L562I/R711K | + |

[a]Levels of increased production were determined relative to the reference polypeptide of SEQ ID NO: 2064, and defined as follows:
"+" = production at least 15-fold, but less than 38.25-fold;
"++" = at least 38.25-fold, but less than 50.3-fold increased production; and
"+++" = at least 50.3-fold increased production, relative to the reference polypeptide.

TABLE 38.2

SUS Round 12 Saturation Mutagenesis Variants and RebD Levels

| SEQ ID NO: (nt/aa) | Amino Acid Differences (Relative to SEQ ID NO: 2064) | Increased RebD[a] |
|---|---|---|
| 2433/2434 | V641L | + |
| 2435/2436 | L688H | + |
| 2437/2438 | Q487K | +++ |
| 2439/2440 | A41K | ++ |
| 2441/2442 | F684M | ++ |
| 2443/2444 | L186V | + |
| 2445/2446 | I91G | + |
| 2447/2448 | G112Q | ++ |
| 2449/2450 | V89M | + |
| 2451/2452 | Q487T | ++ |
| 2453/2454 | F684G | + |
| 2455/2456 | F684T | + |
| 2457/2458 | A25T/G112W | ++ |
| 2459/2460 | P226V | + |
| 2461/2462 | L764R | +++ |
| 2463/2464 | L688G | ++ |
| 2465/2466 | L688A | +++ |
| 2467/2468 | V763L | + |
| 2469/2470 | F684H | ++ |
| 2471/2472 | S330A | + |
| 2473/2474 | R21Q | + |
| 2475/2476 | G112R | + |
|

TABLE 38.2-continued

SUS Round 12 Saturation Mutagenesis Variants and RebD Levels

| SEQ ID NO: (nt/aa) | Amino Acid Differences (Relative to SEQ ID NO: 2064) | Increased RebD[a] |
|---|---|---|
| 2485/2486 | L688Q | +++ |
| 2487/2488 | P318A | + |
| 2489/2490 | G485A | ++ |
| 2491/2492 | G485S | ++ |
| 2493/2494 | V89L | + |
| 2495/2496 | I91C | ++ |
| 2497/2498 | L688F | +++ |
| 2499/2500 | Q487I | +++ |
| 2501/2502 | S674A | + |

[a]Levels of increased production were determined relative to the reference polypeptide of SEQ ID NO: 2064, and defined as follows:
"+" = production at least 2-fold, but less than 3.7-fold;
"++" = at least 3.7-fold, but less than 6.4-fold; and
"+++" = at least 6.4-fold increased production, relative to the reference polypeptide.

Shake Flask Powder Characterization Assay and Analysis for Glucosyl Transfer from Sucrose to Rebaudioside A An experiment was performed to characterize the activity of the engineered round 12 SUS variants on sucrose and ADP to facilitate the formation of rebaudioside D from rebaudioside A. Shake flask powder (SFP) was made up to 0.03-1 g/L in potassium phosphate buffer, pH6, and an aliquot was pre-incubated at 68° C. in a thermocycler for 15 minutes. Then, 10 µL of these SFP dilutions, either pre-incubated or not pre-incubated, were added to a 100 µL total reaction volume containing 50 mM potassium phosphate buffer, pH6, 15 mM rebaudioside A (>97% purity), 37.5 mM sucrose, 9 mM fructose, 0.2 mM ADP, and 0.5 g/L GT SEQ ID NO: 4256. The reactions were performed at 55° C. for SFP samples that were not pre-incubated and at 60° C. for pre-incubated SFP in a Thermotron® titre-plate shaker with 300 RPM shaking for 4h. The reaction was solubilized by diluting 40× into water, quenched by diluting 10× into acetonitrile with 0.2% formic acid, and precipitated by centrifugation. The supernatant was diluted 3.3× in water and analyzed for steviol glycosides by RapidFire SPE-MS/MS with the instrument and parameters described in Table 31.1. A further thermostability characterization was conducted with the clarified shake flask lysates prior to lyophilization as follows: lysates were diluted 400× in buffer and incubated in a thermocycler at a gradient of 55-70° C. for 16-18 h. To determine the % activity remaining, the pre-incubated lysates were assayed as described above with either stevioside or rebaudioside D and 4h incubation at 55° C. The percent activity remaining was expressed as activity at high temperature divided by activity at lowest pre-incubated temperature. All 7 of the variants listed in Table 38.3 had higher activities than SEQ ID NO: 2064 under the pre-incubated conditions, and two also were less deleterious under the 55° C. condition. The variant with the mutations P57W, L562, and R711K (SEQ ID NO:2432), which was improved under all conditions relative to SEQ ID NO: 2064 and contained the top mutation from the round 10 saturation mutagenesis screen, was selected for further directed evolution for the catalysis of the recycling reaction transferring a glucose from sucrose to ADP.

TABLE 38.3

SUS Round 12 SFP Variants and RebD Levels

| SEQ ID NO: (nt/aa) | Amino Acid Differences (Relative to SEQ ID NO: 2064) | Increased RebD, 55° C.[a] | Increased RebD, 60° C.[a] | % Activity Remaining[b] |
|---|---|---|---|---|
| 2333/2334 | N347R/S531R/Q550I/R711K | − | ++ | ++ |
| 2373/2374 | L562I/R711K | − | +++ | + |
| 2389/2390 | S531R/S532Y/E536L/S539R/L562I/R711K/A789N | − | ++ | ++ |
| 2405/2406 | P57W/R71Q/E129T/Y434H/S531R/E536L/L562I | − | ++ | +++ |
| 2427/2428 | S532Y/S539R/Q550I | + | +++ | ++ |
| 2429/2430 | E129G/Q550I/L562I | − | ++ | ++ |
| 2431/2432 | P57W/L562I/R711K | + | +++ | ++ |

[a]Levels of increased production were determined relative to the reference polypeptide of SEQ ID NO: 2064, and defined as follows:
"−" = production less than 0.8-fold that of the reference polypeptide;
"+" = production at least 0.8-fold, but less than 1.2-fold;
"++" = production at least 1.2-fold, but less than 4.7-fold; and
"+++" = production at least 4.7-fold increased, relative to that of the reference polypeptide.
[b]The percent of activity remaining for each variant was determined following 16-18 h pre-incubation at 65° C., relative to the production of each variant following pre-incubation at 55° C. and is defined as follows:
"−" = less than 55% of activity remained following pre-incubation at 55° C.;
"+" = at least 55% activity, but less than 65% activity remained;
"++" = at least 65% activity, but less than 75% activity remained; and
"+++" = at least 75% activity remained.

Example 39

Sucrose Synthase Variants of SEQ ID NO: 2432

Directed evolution of the sucrose synthase encoded by SEQ ID NO: 2431, was continued by constructing libraries of variant genes in which mutations associated with improved activity in earlier rounds of evolution were recombined and in which certain structural features were subjected to saturation mutagenesis. These libraries were then plated, grown, and screened using the high-throughput (HTP) assay described below, to provide a thirteenth round ("Round 13") of 46 engineered SuS variant polypeptides with increased activity toward the generation of ADP-glucose.

HTP Coupled Assay for Glucose Transfer from Sucrose to ADP to Rebaudioside A

Libraries were screened using the following HTP enzyme-coupled assay. Pelleted E. coli cultures were lysed with 400 µL of Tris-HCl, pH 7.5, with 1 mM magnesium sulfate and 0.5 mg/mL lysozyme and polymyxin B sulfate (PMBS) and cleared by centrifugation. For the combinatorial library, lysate was diluted 10× into potassium phosphate buffer, pH 6.0, and pre-incubated for 15 minutes at 73° C. For the saturation mutagenesis library, lysate was diluted 20× into potassium phosphate buffer, pH 6.0, and pre-incubated for 17.5 hours at 62° C. Then, 10 µL diluted, pre-incubated SuS lysate and 0.5 g/L GT SEQ ID NO: 4256 or 4550 were used in 100 µL reaction volume with 15 mM rebaudioside A (>97% purity), 0.2 mM ADP (Amresco, >93%), 37.5 mM sucrose (cane sugar), and 9 mM fructose. The following reaction conditions were used: 50 mM potassium phosphate buffer, pH 6, 60° C. in a Thermotron® titre-plate shaker with 300 RPM shaking for 3-4 h. The reaction described above was solubilized by diluting 40× in water, quenched by diluting 5× in acetonitrile with 0.2% formic acid, and precipitated by centrifugation. The supernatant was diluted 7.5× in water and steviol glycoside products were detected by RapidFire SPE-MS/MS with the instrument and parameters described in Table 31.1. After analysis, the engineered SuS variant polypeptides that showed improved activity coupled with a GT on rebaudioside A were identified and are listed in Tables 39.1 and 39.2. Shake-flask scale cultures were grown for protein characterization as described in Example 31 for variants with the amino acid mutations shown in Table 39.3.

TABLE 39.1

SUS Round 13 Combinatorial Variants and RebD Levels

| SEQ ID NO: (nt/aa) | Amino Acid Differences (Relative to SEQ ID NO: 2432) | Increased RebD[a] |
|---|---|---|
| 2503/2504 | Q33H/H154A/I480P/P530F/E534W/G603Q/R606M | + |
| 2505/2506 | L58M/E59A/W79H/S175G/I480P/E534W/Q550I/G652R | + |
| 2507/2508 | Q33H/L58M/E59A/P81G/D130Y/I480V/P530F/E534W/Q550I/G652K | ++ |
| 2509/2510 | Q33H/L47P/E59A/P81L/S175G/P530F/E534W/Q550I/R606M | +++ |
| 2511/2512 | Q33H/D130Y/P530F/E534W/Q550I | + |
| 2513/2514 | Q33H/L58M/E59A/I480P/P530F/E534W/Q550I | ++ |
| 2515/2516 | E59A/H154A/P530F/E534W/Q550I | + |
| 2517/2518 | Q33H/W79H/P81L/S175G/P530F/E534W/G603Q | + |
| 2519/2520 | Q33H/L58M/H154A/I480P/E534W/Q550I/G603A/R606M | ++ |
| 2521/2522 | Q33H/P81G/D130Y/I480V/P530F/E534W/Q550I | ++ |
| 2523/2524 | Q33H/W79H/P81G/S175G/P530F/E534W | + |
| 2525/2526 | P81G/I480V/P530F/E534W/Q550I | + |
| 2527/2528 | Q33H/E59A/I480P/P530F/E534W/Q550I/R606M | +++ |
| 2529/2530 | Q33H/H154A/E534W | + |
| 2531/2532 | W79H/P81I/I480P/P530F/E534W/Q550I/G603E/R606M/G652R | ++ |
| 2533/2534 | Q33H/W79H/H154A/I480P/P530F/E534W/Q550I | ++ |
| 2535/2536 | Q33H/P530F/E534W/Q550I | + |
| 2537/2538 | D130Y/I480V/P530F/E534W/Q550I/G603Q/R606M | + |
| 2539/2540 | Q33H/P81I/S175G/P530F/E534W/F542W/Q550I/G652R | +++ |

[a]Levels of increased production were determined relative to the reference polypeptide of SEQ ID NO: 2432, and defined as follows:
"+" = production at least 1.2-fold, but less than 5.2-fold;
"++" = at least 5.2-fold, but less than 30-fold; and
"+++" = at least 30-fold increased production, relative to the reference polypeptide.

TABLE 39.2

SUS Round 13 Saturation Mutagenesis Variants and RebD Levels

| SEQ ID NO: (nt/aa) | Amino Acid Differences (Relative to SEQ ID NO: 2432) | Increased RebD[a] |
|---|---|---|
| 2541/2542 | L561I | +++ |
| 2543/2544 | D42H | + |
| 2545/2546 | V267I | + |
| 2547/2548 | T410S | ++ |
| 2549/2550 | F70R | ++ |
| 2551/2552 | F70V | + |
| 2553/2554 | T199A | ++ |
| 2555/2556 | D42S | ++ |
| 2557/2558 | A380T | + |
| 2559/2560 | G758R | + |
| 2561/2562 | A25G | + |
| 2563/2564 | A25E | ++ |
| 2565/2566 | D42T | +++ |
| 2567/2568 | F70S | + |
| 2569/2570 | S265A | + |
| 2571/2572 | F77W | ++ |
| 2573/2574 | M75T | + |
| 2575/2576 | F77L | ++ |
| 2577/2578 | M75W | + |
| 2579/2580 | F70H | + |
| 2581/2582 | A25L | + |
| 2583/2584 | L561V | +++ |
| 2585/2586 | Y106W | +++ |
| 2587/2588 | F70N | +++ |
| 2589/2590 | A642V | + |
| 2591/2592 | G758Q | ++ |
| 2593/2594 | S265Q | + |

[a]Levels of increased production were determined relative to the reference polypeptide of SEQ ID NO: 2432, and defined as follows:
"+" = production at least that of the reference polypeptide, but less than 1.08-fold;
"++" = at least 1.08-fold, but less than 1.16-fold; and
"+++" = at least 1.16-fold increased production, relative to the reference polypeptide.

Shake Flask Powder Characterization Assay and Analysis for Glucosyl Transfer from Sucrose to Rebaudioside A An experiment was performed to characterize the activity of the engineered round 13 SUS variants on sucrose and ADP to facilitate the formation of rebaudioside D from rebaudioside A. Shake flask powder (SFP) was made up to 0.03-1 g/L in potassium phosphate buffer, pH6, and an aliquot was pre-incubated at 73° C. in a thermocycler for 15 minutes. Then, 10 μL of these SFP dilutions, either pre-incubated or not pre-incubated, were added to a 100 μL total reaction volume containing 50 mM potassium phosphate buffer, pH6, 15 mM rebaudioside A (>97% purity), 37.5 mM sucrose, 9 mM fructose, 0.2m ADP, and 0.5 g/L GT SEQ ID NO: 4550. The reactions were performed at 55° C. for SFP samples that were not pre-incubated and at 60° C. for pre-incubated SFP in a Thermotron® titre-plate shaker with 300 RPM shaking for 4h. The reaction was solubilized by diluting 40× into water, quenched by diluting 5× into acetonitrile with 0.2% formic acid, and precipitated by centrifugation. The supernatant was diluted 3.3× in water and analyzed for steviol glycosides by RapidFire SPE-MS/MS with the instrument and parameters described in Table 31.1. A further thermostability characterization was conducted with the clarified shake flask lysates prior to lyophilization as follows: lysates were diluted 400× in buffer and incubated in a thermocycler at a gradient of 62-78° C. for 16.7 h. To determine the percent activity remaining, the pre-incubated lysates were assayed as described above with either stevioside or rebaudioside D and 4h incubation at 60° C. The percent activity remaining was expressed as activity at high temperature divided by activity at lowest pre-incubated temperature. All 8 of the variants listed in Table 39.3 had higher activities than SEQ ID NO: 2432 under at least one condition, and five were improved under all conditions. The variant with the mutations Q33H, L47P, E59A, P81L, S175G, P530F, E534W, Q550I, and R606M (SEQ ID NO: 2510), which was improved under all conditions relative to SEQ ID NO:2432, was selected as the best enzyme for the catalysis of the recycling reaction transferring a glucose from sucrose to ADP.

TABLE 39.3

SUS Round 13 SFP Variants and RebD Levels

| SEQ ID NO: (nt/aa) | Amino Acid Differences (Relative to SEQ ID NO: 2432) | Increased RebD, 55° C.[a] | Increased RebD, 60° C.[a] | % Activity Remaining[b] |
|---|---|---|---|---|
| 2507/2508 | Q33H/L58M/E59A/P81G/D130Y/I480V/P530F/E534W/Q550I/G652K | − | +++ | +++ |
| 2509/2510 | Q33H/L47P/E59A/P81L/S175G/P530F/E534W/Q550I/R606M | + | ++ | ++ |
| 2513/2514 | Q33H/L58M/E59A/I480P/P530F/E534W/Q550I | + | + | + |
| 2519/2520 | Q33H/L58M/H154A/I480P/E534W/Q550I/G603A/R606M | + | − | + |
| 2521/2522 | Q33H/P81G/D130Y/I480V/P530F/E534W/Q550I | − | + | ++ |
| 2527/2528 | Q33H/E59A/I480P/P530F/E534W/Q550I/R606M | + | ++ | + |
| 2533/2534 | Q33H/VV79H/H154A/I480P/P530F/E534W/Q550I | + | + | +++ |
| 2539/2540 | Q33H/P81I/S175G/P530F/E534W/F542W/Q550I/G652R | + | +++ | ++ |

[a]Levels of increased production were determined relative to the reference polypeptide of SEQ ID NO: 2432, and defined as follows:
"−" = production less than that of the reference polypeptide;
"+" = production at least that of the reference polypeptide, but less than 1.6-fold;
"++" = production at least 1.6-fold, but less than 3.7-fold; and
"+++" = production at least 3.7-fold increased, relative to that of the reference polypeptide.
[b]The percent of activity remaining for each variant was determined following 16.7 h pre-incubation at 66.5° C., relative to the production of each variant following pre-incubation at 62° C., and are defined as follows:
"−" = less than 40% of activity remained following pre-incubation at 62° C.;
"+" = at least 40% activity, but less than 60% activity remained;
"++" = at least 60% activity, but less than 70% activity remained; and
"+++" = at least 70% activity remained.

Example 40

Sucrose Synthase Variants of SEQ ID NO: 2510

Directed evolution of the sucrose synthase encoded by SEQ ID NO: 2509 was continued by constructing libraries of variant genes in which mutations associated with improved production in earlier rounds of evolution were recombined and in which certain structural features were subjected to saturation mutagenesis. These libraries were then plated, grown, and screened using the high-throughput (HTP) assay described below, to provide a fourteenth round ("Round 14") of 164 engineered SuS variant polypeptides with increased activity toward the generation of ADP-glucose.

HTP Coupled Assay for Glucose Transfer from Sucrose to ADP to Rebaudioside A60 to Form Rebaudioside M Libraries were screened using the following HTP enzyme-coupled assay. Pelleted *E. coli* cultures were lysed with 400 µL of Tris-HCl, pH 7.5, with 1 mM magnesium sulfate and 0.5 mg/mL lysozyme and polymyxin B sulfate (PMBS) and cleared by centrifugation. Lysate was diluted 35× into potassium phosphate buffer, pH 6.0, with 14.5 g/L RebA60 and pre-incubated for 15 minutes at 73° C. Then, 10 µL diluted pre-incubated SuS lysate, 0.08 g/L β1,2GT SFP SEQ ID NO: 4550, and 0.2 g/L β1,3GT SFP SEQ ID NO: 6864 were used in 100 µL reaction volume with 20 g/L RebA60, 0.1 g/L ADP (Amresco, ultra pure grade), 40 g/L sucrose (cane sugar), and 9.6 g/L fructose. The following reaction conditions were used: 50 mM potassium phosphate buffer, pH 6, 60° C. in a Thermotron® titre-plate shaker with 300 RPM shaking for 16-18 h. The reaction described above was solubilized by diluting 40× in water, quenched by diluting 5× in acetonitrile with 0.2% formic acid, and precipitated by centrifugation. The supernatant was diluted 15× in water and steviol glycoside products were detected by RapidFire SPE-MS/MS with the instrument and parameters described in Table 31.1. After analysis, the engineered SuS variant polypeptides that showed improved activity coupled with a GT on rebaudioside A were identified and are listed in Tables 40.1 and 40.2. Shake-flask scale cultures were grown for protein characterization as described in Example 1 for variants with the amino acid mutations shown in Table 40.3.

TABLE 40.1

SUS Round 14 Combinatorial Variants and RebM Levels

| SEQ ID NO: (nt/aa) | Amino Acid Differences (Relative to SEQ ID NO: 2510) | Increased RebM[a] |
|---|---|---|
| 7437/7438 | D259G/Q487I/F684M/L688G | + |
| 7439/7440 | A41K/R71Q/S532Y/F684H | +++ |
| 7441/7442 | A41K/G485A/Q487K | +++ |
| 7443/7444 | A41K/I91C/G485S | + |
| 7445/7446 | S532Y | ++ |
| 7447/7448 | G112W | + |
| 7449/7450 | A41K/G485A/S532Y/L688G | + |
| 7451/7452 | F684H | ++ |
| 7453/7454 | A41K/G112Q/Q487I/F684H | +++ |
| 7455/7456 | G112Q | ++ |
| 7457/7458 | G485A/F684H/L688G | + |
| 7459/7460 | A41K/R71Q | + |
| 7461/7462 | A41K/D259G/S532Y | + |
| 7463/7464 | A41K/G485S/Q487I/F684M/L688G | + |
| 7465/7466 | A41K/G112W | + |
| 7467/7468 | G112Q/D259G/S532Y/F684M/L688G | + |
| 7469/7470 | A41K/S532Y | ++ |
| 7471/7472 | A41K/R71Q/G112Q/D259G/G485A/L688Q | ++ |
| 7473/7474 | G485A/S532Y | +++ |
| 7475/7476 | R71Q/F684M/L688A | + |
| 7477/7478 | A41K/D259G/G485A/Q487R/F684H/L688A | ++ |
| 7479/7480 | S532Y/F684H/L688Q | + |
| 7481/7482 | A41K | ++ |
| 7483/7484 | G485S/Q487I/F684H/L688Q | + |
| 7485/7486 | A41K/G485A/Q487R | ++ |
| 7487/7488 | G112Q/G485S/F684H/L688G | + |
| 7489/7490 | D259G/S532Y | + |
| 7491/7492 | A41K/G112Q/F684H/L688A | + |
| 7493/7494 | A41K/G485A | ++ |
| 7495/7496 | A41K/R71Q/Q487R | + |
| 7497/7498 | A41K/R71Q/F684H | + |
| 7499/7500 | A41K/R71Q/G485A | ++ |
| 7501/7502 | A41K/D259G/G485A/Q487I | + |
| 7503/7504 | A41K/D259G/G485S | + |
| 7505/7506 | A41K/G112Q/G485S/F684H | ++ |
| 7507/7508 | R71Q/G485S/F684M/L688Q | + |
| 7509/7510 | G485A/Q487R | + |
| 7511/7512 | A41K/R71Q/G112Q | +++ |
| 7513/7514 | G485S/Q487I/F684M | + |
| 7515/7516 | G485S | +++ |
| 7517/7518 | A41K/G84A/D259G/G485A/Q487I | + |
| 7519/7520 | G485S/Q487K/S532Y | +++ |
| 7521/7522 | R71Q/S532Y | ++ |
| 7523/7524 | A41K/Q487R/F684M | ++ |
| 7525/7526 | G112Q/G485S/F684M/L688G | + |
| 7527/7528 | G112Q/D259G/F684M/L688Q | + |
| 7529/7530 | A41K/R71Q/D259G/G485A/S532Y | ++ |
| 7531/7532 | A41K/G112Q/S532Y | ++ |
| 7533/7534 | A41K/F684M/L688A | + |
| 7535/7536 | G485A | ++ |
| 7537/7538 | G485S/Q487R/S532Y/F684H | ++ |
| 7539/7540 | D259G/G485S/Q487K/F684H | +++ |
| 7541/7542 | R71Q/G112W/G485S/L688A | ++ |
| 7543/7544 | R71Q/G112Q/D259G/G485A/Q487R/F684M | + |
| 7545/7546 | A41K/R71Q/S532Y | +++ |
| 7547/7548 | G112W/D259G | +++ |
| 7549/7550 | A41K/G485A/S532Y | +++ |
| 7551/7552 | A41K/I91C/G112Q/G485S/Q487K/S532Y/F684H | + |
| 7553/7554 | A41K/Q487I/F684M | ++ |
| 7555/7556 | A41K/R71Q/G485A/S532Y/F684H | +++ |
| 7557/7558 | A41K/G112Q/D259G/Q487R/S532Y/F684H | +++ |

TABLE 40.1-continued

SUS Round 14 Combinatorial Variants and RebM Levels

| SEQ ID NO: (nt/aa) | Amino Acid Differences (Relative to SEQ ID NO: 2510) | Increased RebM[a] |
|---|---|---|
| 7559/7560 | A41K/G112Q/D259G/G485S/Q487R | ++ |
| 7561/7562 | D259G/G485S/S532Y | ++ |
| 7563/7564 | A41K/F684H | + |
| 7565/7566 | G485S/F684M/L688G | + |
| 7567/7568 | A41K/D259G/G485A/Q487R/S532Y/F684H | + |
| 7569/7570 | A41K/G485S/F684M/L688A | ++ |
| 7571/7572 | A41K/I91C/G112Q/G485S/S532Y/F684H | + |
| 7573/7574 | A41K/R71Q/Q487R/S532Y/F684H | +++ |
| 7575/7576 | G112Q/G485S/F684H | +++ |
| 7577/7578 | A41K/I91C/G112Q/G485S | + |
| 7579/7580 | G485A/F684M | + |
| 7581/7582 | R44C/G112W/F684H/L688A | + |
| 7583/7584 | P226V/Q487I/F684M/L688A | + |
| 7585/7586 | A41K/R71Q/G112W/D259G/G485S/Q487R/F684H/L688Q | ++ |
| 7587/7588 | F684M/L688Q | + |

[a]Levels of increased production were determined relative to the reference polypeptide of SEQ ID NO: 2510, and defined as follows:
"+" = production at least 1.5-fold, but less than 2.9-fold;
"++" = at least 2.9-fold, but less than 4.2-fold; and
"+++" = at least 4.2-fold increased production, relative to the reference polypeptide.

TABLE 40.2

SUS Round 14 Saturation Mutagenesis Variants and RebM Levels

| SEQ ID NO: (nt/aa) | Amino Acid Differences (Relative to SEQ ID NO: 2510) | Increased RebM[a] |
|---|---|---|
| 7589/7590 | R136A | ++ |
| 7591/7592 | R615L | ++ |
| 7593/7594 | H343N | + |
| 7595/7596 | E45C | + |
| 7597/7598 | D12C | + |
| 7599/7600 | D72E | + |
| 7601/7602 | D12V | +++ |
| 7603/7604 | R478I | + |
| 7605/7606 | D12S | +++ |
| 7607/7608 | P48V | + |
| 7609/7610 | L176M | ++ |
| 7611/7612 | H343A | + |
| 7613/7614 | E45G | + |
| 7615/7616 | R136Q | ++ |
| 7617/7618 | D12Q | ++ |
| 7619/7620 | T205S | + |
| 7621/7622 | Q95V | ++ |
| 7623/7624 | H788K | ++ |
| 7625/7626 | E358P | + |
| 7627/7628 | D29G | + |
| 7629/7630 | Q7K/D12L | ++ |
| 7631/7632 | E100K | +++ |
| 7633/7634 | L630M | +++ |
| 7635/7636 | H724S | ++ |
| 7637/7638 | P47I | +++ |
| 7639/7640 | Q95N | + |
| 7641/7642 | I55D | ++ |
| 7643/7644 | P47V | + |
| 7645/7646 | R615K | + |
| 7647/7648 | R136P | +++ |
| 7649/7650 | R478H | ++ |
| 7651/7652 | E45V | ++ |
| 7653/7654 | D12N | +++ |
| 7655/7656 | R44V | + |
| 7657/7658 | L176R | + |
| 7659/7660 | R361A | + |
| 7661/7662 | R44L | + |
| 7663/7664 | R361L | + |
| 7665/7666 | D29P | +++ |
| 7667/7668 | R136K | + |
| 7669/7670 | P440R | ++ |
| 7671/7672 | L176V | + |
| 7673/7674 | P47C | + |
| 7675/7676 | E45A | +++ |
| 7677/7678 | L116A | ++ |
| 7679/7680 | R303V | + |
| 7681/7682 | Q27R | + |
| 7683/7684 | R611A | +++ |
| 7685/7686 | Q95T | +++ |
| 7687/7688 | E45L | ++ |
| 7689/7690 | R615C | + |
| 7691/7692 | D29A | ++ |
| 7693/7694 | P47N | + |
| 7695/7696 | R178H | + |
| 7697/7698 | H724G | ++ |
| 7699/7700 | R136F | +++ |
| 7701/7702 | P47T | + |
| 7703/7704 | P47L | +++ |
| 7705/7706 | Q95L | + |
| 7707/7708 | Q95D | ++ |
| 7709/7710 | D29L | +++ |
| 7711/7712 | R361T | + |
| 7713/7714 | L176T | + |
| 7715/7716 | E100P | ++ |
| 7717/7718 | E100Q | + |
| 7719/7720 | S675C | +++ |
| 7721/7722 | T205R/G485S | + |
| 7723/7724 | V756C | ++ |
| 7725/7726 | H724K | ++ |
| 7727/7728 | P47D | + |
| 7729/7730 | P207K | + |
| 7731/7732 | Q198A | + |
| 7733/7734 | Y51P | + |
| 7735/7736 | P48A | + |
| 7737/7738 | Q198R | ++ |
| 7739/7740 | I55S | + |
| 7741/7742 | R136N | ++ |
| 7743/7744 | Y51S | ++ |
| 7745/7746 | Q201S | + |
| 7747/7748 | R139K | ++ |
| 7749/7750 | E358S | +++ |
| 7751/7752 | E317I | + |
| 7753/7754 | R208K | + |
| 7755/7756 | R615M | +++ |
| 7757/7758 | K280G | + |
| 7759/7760 | E45S | ++ |
| 7761/7762 | L116F | +++ |
| 7763/7764 | R478Q | + |

[a]Levels of increased production were determined relative to the reference polypeptide of SEQ ID NO: 2510, and defined as follows: "+" = production at least 1.5-fold, but less than 1.92-fold; "++" = at least 1.92-fold, but less than 2.6-fold; and "+++" = at least 2.6-fold increased production, relative to the reference polypeptide.

Shake Flask Powder Characterization Assay and Analysis for Glucosyl Transfer from Sucrose to Rebaudioside A60 to form Rebaudioside M An experiment was performed to characterize the activity of the engineered round 14 SUS variants on sucrose and ADP to facilitate the formation of rebaudioside D from rebaudioside A. Shake flask powder (SFP) was made up to 0.03-1 g/L in 14.5 μL RebA60 in potassium phosphate buffer, pH 6, and an aliquot was pre-incubated at 73° C. in a thermocycler for 15 minutes. Then, 10 μL diluted, pre-incubated SuS lysate, 0.08 g/L β1,2GT SFP SEQ ID NO: 4550, and 0.2 g/L β1,3GT SFP SEQ ID NO: 6864, were used in 100 μL reaction volume with 20 μL RebA60, 0.1 g/L ADP (Amresco, ultra pure grade), 40 g/L sucrose (cane sugar), and 9.6 g/L fructose. The following reaction conditions were used: 50 mM potassium phosphate buffer, pH 6, 60° C. in a Thermotron® titre-plate shaker with 300 RPM shaking for 16-18 h. The reaction described above was solubilized by diluting 40× in water, quenched by diluting 5× in acetonitrile with 0.2% formic acid, and precipitated by centrifugation. The supernatant was diluted 15× in water and steviol glycoside products were detected by RapidFire SPE-MS/MS with the instrument and parameters described in Table 31.1. All 8 of the variants listed in Table 40.3 had higher activities than SEQ ID NO: 2510. The variant with the mutations A41K, G112Q, G485S, and F684H (SEQ ID NO:7506), which was most improved relative to SEQ ID NO: 2510, was selected as the best enzyme for the catalysis of the recycling reaction transferring a glucose from sucrose to ADP.

TABLE 40.3

SUS Round 14 SFP Variants and RebM Levels

| SEQ ID NO: (nt/aa) | Amino Acid Differences (Relative to SEQ ID NO: 2510) | Increased RebM[a] |
|---|---|---|
| 7439/7440 | A41K/R71Q/S532Y/F684H | +++ |
| 7453/7454 | A41K/G112Q/Q487I/F684H | ++ |
| 7493/7494 | A41K/G485A | + |
| 7505/7506 | A41K/G112Q/G485S/F684H | +++ |
| 7515/7516 | G485S | + |
| 7549/7550 | A41K/G485A/S532Y | ++ |
| 7555/7556 | A41K/R71Q/G485A/S532Y/F684H | + |
| 7575/7576 | G112Q/G485S/F684H | + |

[a]Levels of increased production were determined relative to the reference polypeptide of SEQ ID NO: 2510, and defined as follows: "+" = production at least 2.1-fold, but less than 2.85-fold; "++" = production at least 2.85-fold, but less than 3.1-fold; and "+++" = production at least 3.1-fold increased, relative to that of the reference polypeptide.

Example 41

Sucrose Synthase Variants of SEQ ID NO: 7506

Directed evolution of the sucrose synthase encoded by SEQ ID NO: 7505 was continued by constructing libraries of variant genes in which mutations associated with improved production in earlier rounds of evolution were recombined and in which certain structural features were subjected to saturation mutagenesis. These libraries were then plated, grown, and screened using the high-throughput (HTP) assay described below, to provide a fifteenth round ("Round 15") of 56 engineered SuS variant polypeptides with increased activity toward the generation of ADP-glucose.

HTP Coupled Assay for Glucose Transfer from Sucrose to ADP to Rebaudioside A 60 to Form Rebaudioside M Libraries were screened using the following HTP enzyme-coupled assay. Pelleted E. coli cultures were lysed with 400 μL of Tris-HCl, pH 7.5 with 1 mM magnesium sulfate and 0.5 mg/mL lysozyme and polymyxin B sulfate (PMBS) and cleared by centrifugation. Lysate was diluted 50× into potassium phosphate buffer, pH 6.0, with 14.5 g/L RebA60 and pre-incubated for 15 minutes at 73° C. Then, 10 μL diluted, pre-incubated SuS lysate, 0.08 g/L β1,2GT SFP SEQ ID NO: 4550, and 0.2 g/L β1,3GT SFP SEQ ID NO: 6864, were used in 100 μL reaction volume with 20 g/L RebA60, 0.1 g/L ADP (Amresco, ultra pure grade), 40 g/L sucrose (cane sugar), and 9.6 g/L fructose. The following reaction conditions were used: 50 mM potassium phosphate buffer, pH 6, 60° C. in a Thermotron® titre-plate shaker with 300 RPM shaking for 16-18 h. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 31.1. After analysis, the engineered SuS variant polypeptides that showed improved activity coupled with a GT on rebaudioside A were identified and are listed in Table 41.1. Shake-flask scale cultures were grown for protein characterization as described in Example 1 for variants with the amino acid mutations shown in Table 41.2.

TABLE 41.1

SUS Round 15 Combinatorial Variants and RebM Levels

| SEQ ID NO: (nt/aa) | Amino Acid Differences (Relative to SEQ ID NO: 7506) | Increased RebM[a] |
|---|---|---|
| 8369/8370 | D12N/E45A/P47I/Y51P/R136P/R139K/L630M/G758R | ++ |
| 8371/8372 | D12N/E45A/Y51P/R136P/R139K/L630M/S675C/V756C/G758Q | +++ |
| 8373/8374 | D12S/E45A/Y51P/L630M/V756C | ++ |
| 8375/8376 | R136P/R139K/S142N | ++ |
| 8377/8378 | D12N/R136Q/S142N | +++ |
| 8379/8380 | D12V/E45A/P47I/R136Q/R139K/S142N/S675C/G758Q | +++ |
| 8381/8382 | D12V/E45A/P47L | +++ |
| 8383/8384 | D12V/R136Q/R139K/S142N/V756C/G758Q | +++ |
| 8385/8386 | D12S/L630M/V756C | ++ |
| 8387/8388 | D12N/P48A/Y51P/R136Q/R139K/G758Q | +++ |
| 8389/8390 | D12V/E45A/P47I/P48A/Y51S/R136Q/S142N/L630M | +++ |
| 8391/8392 | P47I/Y51S/R136Q/V756C/G758Q | ++ |
| 8393/8394 | T199A/S532Y/S539R/L561I/G652R/H724S | + |
| 8395/8396 | S532Y/L561I/H724K | + |
| 8397/8398 | Q198R/I480P/L561I | ++ |
| 8399/8400 | Q198R/T199A/L561V/H724G | +++ |
| 8401/8402 | D42T/Q198R/S532Y/L561I/H724K | ++ |
| 8403/8404 | Y106W/T199A/S539R/L561I/G652R | ++ |
| 8405/8406 | I480V/L561V/G652R | ++ |
| 8407/8408 | Q198R/I480V/H724K | ++ |
| 8409/8410 | D42T/Q198R/S532Y/L561V | ++ |
| 8411/8412 | D42T/D259G/I480V/L561V | + |
| 8413/8414 | Q198R/T199A/I480P/L561I | ++ |
| 8415/8416 | S532Y/S539R/L561V | + |
| 8417/8418 | D42T/Q198R/T199A/I480V/S532Y/S539R/L561V | +++ |
| 8419/8420 | D42T/I480V/L561I/H724K | +++ |
| 8421/8422 | D42T/I480P/L561I | ++ |
| 8423/8424 | D42T/L561I | ++ |
| 8425/8426 | D259G/I480V | + |
| 8427/8428 | I480V/L561V/G652R/H724K/L764R | + |
| 8429/8430 | I480V/H724K | ++ |
| 8431/8432 | Q198R/T199A/I480P/L561V/H724K | ++ |
| 8433/8434 | D42T/D259G/I480V/G652K | + |
| 8435/8436 | D42T/T199A/I480V/S532Y/L561V | +++ |
| 8437/8438 | A25E/A517P | + |
| 8439/8440 | H154A/R361T/P440R/A517P/G603E/H788K | + |
| 8441/8442 | Q95T/G603E | + |
| 8443/8444 | A25E/E100K/H154A/R208K/P440R/A517P/P705M/H788K | + |
| 8445/8446 | A25E/D29P/R208K/P440R | + |
| 8447/8448 | K280G/P440R/A517P | + |
| 8449/8450 | A517P | + |
| 8451/8452 | I55D/A517P/H788K | ++ |
| 8453/8454 | I55D/A517P | + |
| 8455/8456 | I55D | + |
| 8457/8458 | Q8R/A25E/I55D/Q95T/R208K/E358S/P440V/A517P/H788K | + |
| 8459/8460 | D29P/R208K/R361T/A517P/H788K | + |
| 8461/8462 | G603E | + |
| 8463/8464 | I55D/T410S/P440R/G603E/H788K | + |
| 8465/8466 | A642V | + |
| 8467/8468 | F77L/L176M/Q487K/R615M/A642V | + |
| 8469/8470 | F70N/A642V | + |
| 8471/8472 | L116F | + |
| 8473/8474 | A380T | + |
| 8475/8476 | L176T | + |
| 8477/8478 | F70N | + |
| 8479/8480 | V267I/R611Q/A642V | + |

[a]Levels of increased production were determined relative to the reference polypeptide of SEQ ID NO: 7506, and defined as follows: "+" = activity at least 1.07-fold, but less than 1.95-fold; "++" = at least 1.95-fold, but less than 2.4-fold; and "+++" = at least 2.4-fold increased production, relative to the reference polypeptide.

Shake Flask Powder Characterization Assay and Analysis for Glucosyl Transfer from Sucrose to Rebaudioside A60 to form Rebaudioside M An experiment was performed to characterize the activity of the engineered round 15 SUS variants on sucrose and ADP to facilitate the formation of rebaudioside D from rebaudioside A. Shake flask powder (SFP) was made up to 0.03-1 g/L in 14.5 g/L RebA6 in potassium phosphate buffer, pH 6, and an aliquot was pre-incubated at 73° C. in a thermocycler for 15 minutes. 10 µL diluted, pre-incubated SuS lysate, 0.08 g/L β1,2GT SFP SEQ ID NO: 4550, and 0.2 g/L β1,3GT SFP SEQ ID NO: 6864, were used in 100 µL reaction volume with 20 g/L RebA60, 0.1 g/L ADP (Amresco, ultra pure grade), 40 g/L sucrose (cane sugar), and 9.6 g/L fructose. The following reaction conditions were used: 50 mM potassium phosphate buffer, pH 6, 60° C. in a Thermotron® titre-plate shaker with 300 RPM shaking for 16-18 h. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 31.1. All 8 of the variants listed in Table 41.2 had higher activities than SEQ ID NO: 7506. The variant with the mutations D42T, I480V, L561I, and H724K (SEQ ID NO: 8420), which was most improved relative to SEQ ID NO: 7506, was selected as the best enzyme for the catalysis of the recycling reaction transferring a glucose from sucrose to ADP.

TABLE 41.2

SUS Round 15 SFP Variants and RebM Levels

| SEQ ID NO: (nt/aa) | Amino Acid Differences (Relative to SEQ ID NO: 7506) | Increased RebM[a] |
|---|---|---|
| 8371/8372 | D12N/E45A/Y51P/R136P/R139K/L630M/ S675C/V756C/G758Q | + |
| 8383/8384 | D12V/R136Q/R139K/S142N/V756C/G758Q | + |
| 8389/8390 | D12V/E45A/P47I/P48A/Y51S/R136Q/ S142N/L630M | ++ |
| 8399/8400 | Q198R/T199A/L561V/H724G | + |
| 8419/8420 | D42T/I480V/L561I/H724K | +++ |
| 8439/8440 | H154A/R361T/P440R/A517P/G603E/H788K | +++ |
| 8451/8452 | I55D/A517P/H788K | ++ |
| 8475/8476 | L176T | + |

[a]Levels of increased production were determined relative to the reference polypeptide of SEQ ID NO: 7506, and defined as follows: "+" = production at least 2.1-fold, but less than 2.2-fold; "++" = production at least 2.2-fold, but less than 2.3-fold; and "+++" = production at least 2.3-fold increased, relative to that of the reference polypeptide.

Example 42

Sucrose Synthase Variants of SEQ ID NO: 8420

Directed evolution of the sucrose synthase encoded by SEQ ID NO: 8419 was continued by constructing libraries of variant genes in which mutations associated with improved production in earlier rounds of evolution were recombined. These libraries were then plated, grown, and screened using the high-throughput (HTP) assay described below, to provide a sixteenth round ("Round 16") of 155 engineered SuS variant polypeptides with increased activity toward the generation of ADP-glucose.

HTP Coupled Assay for Glucose Transfer from Sucrose to ADP to Rebaudioside A 60 to Form Rebaudioside M Libraries were screened using the following HTP enzyme-coupled assay. Pelleted E. coli cultures were lysed with 400 µL of Tris-HCl, pH 7.5 with 1 mM magnesium sulfate and 0.5 mg/mL lysozyme and polymyxin B sulfate (PMBS) and cleared by centrifugation. Lysate was diluted 30× into potassium phosphate buffer, pH 6.0, with 14.5 g/L RebA60 and pre-incubated for 1 hour at 75° C. Then, 10 µL diluted, pre-incubated SuS lysate, 0.08 g/L β1,2GT SFP SEQ ID NO: 7784, and 0.2 g/L β1,3GT SFP SEQ ID NO: 8088, were used in 100 µL reaction volume with 20 g/L RebA60, 0.025 g/L ADP (Amresco, ultra pure grade), 40 g/L sucrose (cane sugar), and 9.6 g/L fructose. The following reaction conditions were used: 50 mM potassium phosphate buffer, pH 6, 60° C. in a Thermotron® titre-plate shaker with 300 RPM shaking for 16-18 h. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 31.1. After analysis, the engineered SuS variant polypeptides that showed improved activity coupled with a GT on rebaudioside A were identified and are listed in Table 42.1. Shake-flask scale cultures were grown for protein characterization as described in Example 1 for variants with the amino acid mutations shown in Table 42.2.

TABLE 42.1

SUS Round 16 Combinatorial Variants and RebM Levels

| SEQ ID NO: (nt/aa) | Amino Acid Differences (Relative to SEQ ID NO: 8420) | Increased RebM[a] |
|---|---|---|
| 8797/8798 | D12S/E45A/L176T/G603Q/L630M/A642V/V756C | + |
| 8799/8800 | D12N/T199A/R208K/A517P/A642V | + |
| 8801/8802 | D12N/E45A/R136Q/R208K/A517P/L630M/V756C | +++ |
| 8803/8804 | D12S/R139K/G603Q/V756C | + |
| 8805/8806 | R136Q/R139K/G603Q | + |
| 8807/8808 | R136Q/R139K/A517P/G603Q/V756C | +++ |
| 8809/8810 | D12S/R136Q/T199A/R208K/L630M/A642V | ++ |
| 8811/8812 | D12S/R136Q/R139K/R208K/A517P | ++ |
| 8813/8814 | D12N/E45A/R136Q/R139K/A642V/V756C | ++ |
| 8815/8816 | D12S/R139K/L176T/L630M/V756C | + |
| 8817/8818 | D12S/R136Q/A517P/G603Q/L630M/A642V | ++ |
| 8819/8820 | D12S/R136Q/R139K/L176T/V756C | + |
| 8821/8822 | D12N/E45A/R136Q/A517P/L630M/A642V/V756C | +++ |
| 8823/8824 | D12N/E45A/R136Q/G603E/V756C | + |
| 8825/8826 | D12S/E45A/R136Q/R139K/R208K/G603E/L630M/V756C | ++ |
| 8827/8828 | D12S/R136Q/L176T/R208K/A517P/G603E/L630M/V756C | +++ |
| 8829/8830 | D12N/L176T/A517P/V756C | + |
| 8831/8832 | D12S/R136Q/R208K/G603Q/A642V | + |
| 8833/8834 | D12N/R136Q/R139K/G603Q/A642V/V756C | +++ |
| 8835/8836 | D12S/R136Q/R139K/G603Q/L630M/V756C | +++ |
| 8837/8838 | D12S/R136Q/R139K/L176T/A517P/G603Q/L630M | +++ |
| 8839/8840 | D12N/R136Q/R139K/L630M | + |
| 8841/8842 | D12S/R136Q/R139K/A517P/L630M | ++ |
| 8843/8844 | D12N/R136Q/T199A/A517P/V756C | + |
| 8845/8846 | D12S/R136Q/R139K/T199A/R208K/A517P/G603E/V756C | +++ |
| 8847/8848 | D12N/E45A/R136Q/R139K/T199A/A517P/G603E | ++ |
| 8849/8850 | D12N/A517P/G603E/V756C | + |
| 8851/8852 | D12N/R136Q/G603Q/L630M/V756C | ++ |
| 8853/8854 | D12N/R136Q/R139K/A642V/V756C | + |
| 8855/8856 | D12S/R136Q/R139K/L630M/A642V/V756C | +++ |
| 8857/8858 | D12N/E45A/R139K/T199A/R208K/G603E | + |
| 8859/8860 | T199A/A517P/G603Q/L630M/V756C | + |
| 8861/8862 | R136Q/R139K/L176T/A517P/L630M/A642V/V756C | +++ |
| 8863/8864 | R136Q/R139K/L176T/T199A/R208K/A517P/L630M/A642V | ++ |

TABLE 42.1-continued

SUS Round 16 Combinatorial Variants and RebM Levels

| SEQ ID NO: (nt/aa) | Amino Acid Differences (Relative to SEQ ID NO: 8420) | Increased RebM[a] |
|---|---|---|
| 8865/8866 | D12S/R136Q/L176T/A517P/A642V | + |
| 8867/8868 | D12N/R139K/G603Q/V756C | + |
| 8869/8870 | D12N/R136Q/G603E/A642V | ++ |
| 8871/8872 | D12N/E45A/R136Q/R139K/A517P/L630M/A642V/V756C | +++ |
| 8873/8874 | D12S/R136Q/L630M | + |
| 8875/8876 | D12N/R136Q/R139K/A517P/V756C | ++ |
| 8877/8878 | R136Q/R139K/A517P/G603E/A642V/V756C | +++ |
| 8879/8880 | D12S/R136Q/R139K/G603Q/L630M/A642V | ++ |
| 8881/8882 | D12N/G603Q/L630M/V756C | + |
| 8883/8884 | D12S/A517P/G603Q/L630M/A642V/V756C | ++ |
| 8885/8886 | D12N/E45A/R136Q/R139K/G603E/V756C | ++ |
| 8887/8888 | D12N/R136Q/R139K/A517P/L630M/A642V | ++ |
| 8889/8890 | D12S/R136Q/R139K/L630M/V756C | ++ |
| 8891/8892 | D12N/Q95T/A517P/L630M/V756C | + |
| 8893/8894 | D12S/Q95T/R139K/A517P/L630M/V756C | ++ |
| 8895/8896 | D12N/E45A/T199A/R208K/A517P/G603E/L630M/V756C | + |
| 8897/8898 | D12N/R136Q/L176T/G603Q/V756C | + |
| 8899/8900 | D12S/R136Q/G603Q/L630M/A642V/V756C | ++ |
| 8901/8902 | D12N/T199A/L630M/A642V/V756C | + |
| 8903/8904 | D12N/L630M/A642V/V756C | + |
| 8905/8906 | D12S/R136Q/A517P/G603Q/L630M/V756C | ++ |
| 8907/8908 | D12N/E45A/R136Q/R139K/A517P/G603E/V756C | +++ |
| 8909/8910 | D12S/R136Q/R139K/A517P/G603Q/L630M/A642V/V756C | +++ |
| 8911/8912 | D12N/Q95T/R136Q/R139K/A517P/G603Q/V756C | ++ |
| 8913/8914 | D12N/R208K/L630M/V756C | + |
| 8915/8916 | D12N/R136Q/R139K/G603E/L630M | +++ |
| 8917/8918 | D12N/R136Q/A517P/L630M | +++ |
| 8919/8920 | R136Q/R139K/A517P/G603Q/L630M/A642V/V756C | +++ |
| 8921/8922 | D12S/R136Q/A517P/A642V/V756C | +++ |
| 8923/8924 | R139K/A517P/L630M/V756C | ++ |
| 8925/8926 | D12S/R139K/A517P/L630M/A642V/V756C | ++ |
| 8927/8928 | A517P/G603E/L630M/A642V/V756C | + |
| 8929/8930 | D12N/L176T/A517P/G603E/L630M | + |
| 8931/8932 | D12S/A517P/A642V/V756C | ++ |
| 8933/8934 | D12S/E45A/Q95T/R136Q/V756C | ++ |
| 8935/8936 | D12N/R139K/A517P/G603Q/A642V/V756C | +++ |
| 8937/8938 | R136Q/A517P/V756C | + |
| 8939/8940 | D12N/G603Q/A642V/V756C | ++ |
| 8941/8942 | D12S/T199A/V756C | + |
| 8943/8944 | D12S/E45A/R139K/V756C | + |
| 8945/8946 | D12S/L176T/G603Q/L630M/V756C | ++ |
| 8947/8948 | D12S/R139K/R208K/A642V | + |
| 8949/8950 | D12N/E45A/Q95T/R136Q/R139K/T199A/A517P/L630M/V756C | +++ |
| 8951/8952 | D12S/R136Q/R139K/A517P/G603E/V756C | +++ |
| 8953/8954 | D12N/R136Q/T199A/R208K/A517P/G603E/A642V/V756C | +++ |
| 8955/8956 | R136Q/R139K/R208K/A517P/L630M/V756C | +++ |
| 8957/8958 | R136Q/R139K/T199A/A517P/G603E/V756C | +++ |
| 8959/8960 | D12S/L630M/V756C | + |
| 8961/8962 | D12S/G603Q/L630M/V756C | ++ |
| 8963/8964 | R136Q/R139K/A517P/V756C | ++ |
| 8965/8966 | D12N/Q95T/R139K/L630M/A642V | + |
| 8967/8968 | D12N/R136Q | + |
| 8969/8970 | D12N/R139K/T199A/A517P/L630M/V756C | +++ |
| 8971/8972 | R139K/A642V/V756C | + |
| 8973/8974 | D12S/R136Q/R139K/A517P/G603E/L630M/V756C | +++ |
| 8975/8976 | D12S/R139K/L176T/A517P/G603Q/L630M/V756C | +++ |
| 8977/8978 | D12N/A517P/L630M/A642V/V756C | + |
| 8979/8980 | D12S/R136Q/A517P/L630M/A642V | + |
| 8981/8982 | D12N/R139K/L630M/A642V/V756C | ++ |
| 8983/8984 | D12N/R136Q/R139K/L176T/A517P/G603Q/V756C | +++ |
| 8985/8986 | R136Q/R139K/L630M/A642V/V756C | ++ |
| 8987/8988 | D12S/R139K/A517P/A642V | + |
| 8989/8990 | D12N/R136Q/G603Q/V756C | ++ |
| 8991/8992 | D12N/Q95T/T199A/A517P/A642V | + |
| 8993/8994 | D12N/R139K/G603E/A642V/V756C | ++ |
| 8995/8996 | R139K/A517P/G603Q/V756C | + |
| 8997/8998 | D12N/R136Q/R139K/L176T/L630M/V756C | +++ |
| 8999/9000 | D12S/E45A/R208K/A517P/G603E/A642V/V756C | + |
| 9001/9002 | D12N/R136Q/G603E/A642V/V756C | ++ |
| 9003/9004 | D12N/A517P/G603Q/L630M/V756C | + |
| 9005/9006 | R139K/T199A/A517P/A642V | + |
| 9007/9008 | G603Q/V756C | + |
| 9009/9010 | D12N/R139K/L630M/V756C | ++ |
| 9011/9012 | D12S/R136Q/A517P/V756C | ++ |
| 9013/9014 | D12S/E45A/R136Q/L176T/A517P/G603E/L630M/A642V | + |
| 9015/9016 | R136Q/A642V | + |
| 9017/9018 | D12S/A517P/L630M/A642V/V756C | ++ |
| 9019/9020 | D12N/R136Q/R139K/L176T/A642V | ++ |
| 9021/9022 | D12N/R136Q/R208K | + |
| 9023/9024 | D12S/R136Q/G603E/V756C | ++ |
| 9025/9026 | D12N/R139K/T199A/R208K/A642V | + |
| 9027/9028 | D12N/R208K/A517P/G603E/H623N/L630M/A642V | + |
| 9029/9030 | A517P/L630M/V756C | + |
| 9031/9032 | D12S/R136Q/A517P/A642V | + |
| 9033/9034 | D12N/E45A/R136Q/L630M/A642V | + |
| 9035/9036 | D12S/R136Q/R139K/A517P/G603E/L630M/A642V/V756C | +++ |
| 9037/9038 | D12N/G603Q/V756C | + |
| 9039/9040 | D12S/Q95T/L630M/V756C | + |
| 9041/9042 | R136Q/A642V/V756C | + |
| 9043/9044 | D12N/R139K/L630M/A642V | + |
| 9045/9046 | D12N/L176T/A517P/L630M/A642V/V756C | ++ |
| 9047/9048 | R136Q/V756C | + |
| 9049/9050 | D12S/E45A/R136Q/R139K/A517P/V756C | ++ |
| 9051/9052 | D12N/G603E/A642V/V756C | + |
| 9053/9054 | R136Q/G603Q/V756C | + |
| 9055/9056 | D12N/R136Q/R139K/A517P | ++ |
| 9057/9058 | R208K/A517P/L630M/A642V/V756C | + |
| 9059/9060 | R136Q/L630M/A642V | + |
| 9061/9062 | D12N/R136Q/R139K/T199A/R208K/A517P/L630M/A642V/V756C | ++ |
| 9063/9064 | R139K/R208K/A517P/L630M/A642V/V756C | + |
| 9065/9066 | R136Q/L630M/V756C | + |
| 9067/9068 | D12S/E45A/R139K/A517P/V756C | + |
| 9069/9070 | R136Q/R139K/R208K/G603Q/L630M/V756C | ++ |
| 9071/9072 | D12N/T199A/A642V/V756C | + |
| 9073/9074 | D12S/R208K/G603Q/L630M/V756C | + |
| 9075/9076 | D12N/Q95T/R139K/A517P/A642V | + |
| 9077/9078 | D12S/L176T/G603E/V756C | + |
| 9079/9080 | D12N/R136Q/R139K/A517P/L630M/A642V/V756C | ++ |
| 9081/9082 | D12S/R136Q/R139K/A517P/G603Q/V756C | ++ |
| 9083/9084 | D12S/R136Q/R139K/A517P/L630M/A642V | ++ |
| 9085/9086 | D12S/R136Q/L630M/V756C | + |
| 9087/9088 | D12N/R139K/R208K/A517P | + |
| 9089/9090 | D12N/E45A/R139K/A517P/V756C | + |
| 9091/9092 | D12S/E45A/R136Q/A517P/G603Q/A642V/V756C/A789V | + |
| 9093/9094 | D12S/E45A/R139K/L176T/R208K/A517P/G603E/L630M | + |
| 9095/9096 | D12N/R136Q/G603Q/A642V/V756C | ++ |
| 9097/9098 | R139K/T199A/R208K/A517P/L630M/V756C | + |
| 9099/9100 | G603E/L630M/V756C | + |
| 9101/9102 | A25E/L176M/Q198R/S532Y/S539R | + |
| 9103/9104 | H154A/S532Y/G652K/H788K | + |
| 9105/9106 | L116F/S142N/Q198R/Y434H/P440R | + |

[a]Levels of increased production were determined relative to the reference polypeptide of SEQ ID NO: 8420, and defined as follows: "+" = production at least 7.8-fold, but less than 16-fold; "++" = at least 16-fold, but less than 22.3-fold; and "+++" = at least 22.3-fold increased production, relative to the reference polypeptide.

Shake Flask Powder Characterization Assay and Analysis for Glucosyl Transfer from Sucrose to Rebaudioside A 60 to form Rebaudioside M An experiment was performed to characterize the activity of the engineered round 16 SUS variants on sucrose and ADP to facilitate the formation of rebaudioside M from rebaudioside A. Shake flask powder (SFP) was made up to 0.03-1 g/L in 4.5 g/L RebA6 in potassium phosphate buffer, pH 6, and an aliquot was pre-incubated at 75° C. for 1 hour. 10 μL diluted, either pre-incubated or not pre-incubated SuS lysate, 0.08 g/L β1,2GT SFP SEQ ID NO: 7784, and 0.2 g/L β1,3GT SFP SEQ ID NO: 8088, were used in 100 μL reaction volume with 20 μL RebA60, 0.025 g/L ADP (Amresco, ultra pure grade), 40 g/L sucrose (cane sugar), and 9.6 g/L fructose. The following reaction conditions were used: 50 mM potassium phosphate buffer, pH 6, 60° C. in a Thermotron® titre-plate shaker with 300 RPM shaking for 16-18 h. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 31.1. All 8 of the variants listed in Table 42.2 had higher production following preincubation than SEQ ID NO:8420. The variant with the mutations D12S, R136Q, R139K, A517P, G603Q, L630M, A642V, and V756C (SEQ ID NO: 8910), which was most improved relative to SEQ ID NO:8420, was selected as the best enzyme for the catalysis of the recycling reaction transferring a glucose from sucrose to ADP.

HTP Assay for Glucose Transfer from ADP-Glucose to Rebaudioside A

Assays were performed on 96-well plates of cleared *E. coli* culture lysates expressing SEQ ID NO: 1053 variants. Lysis buffer volume was 400 μL, and the lysate was diluted 4-fold. Assays were conducted with 10 μL diluted lysate in 100 μL reaction volume with substrate loading of 1 mM rebaudioside A (>97% purity) and co-substrate loading of 1 mM ADP-glucose (Sigma, >93% purity). The following reaction conditions were used: 50 mM potassium phosphate buffer, pH 7, 3 mM $MgCl_2$, 50° C. in a Thermotron® titre-plate shaker with 300 RPM shaking for 1 h. The reactions were diluted 1:5 in water and then quenched by adding 25 μL of the diluted assay to 75 μL acetonitrile with 0.2% formic acid. The resulting mixture was precipitated by centrifugation at 4° C. for 10 m. The supernatants were diluted 1:5 in water and analyzed by RapidFire SPE-MS/MS as described in Table 31.1. Glycosyltransferase variant polypeptides that produced rebaudioside D from rebaudioside A with ADP-glucose were identified, and the engineered polypeptides are listed in Table 43.1. Shake-flask scale cultures were grown, lysed, and lyophilized to powder as described in Example 31 for the variants listed in Table 43.2.

TABLE 42.2

SUS Round 16 SFP Variants and RebM Levels

| SEQ ID NO: (nt/aa) | Amino Acid Differences (Relative to SEQ ID NO: 8420) | Increased RebM without pre-incubation[a] | Increased RebM with 75° C. pre-incubation[a] |
|---|---|---|---|
| 8827/8828 | D12S/R136Q/L176T/R208K/A517P/G603E/L630M/V756C | + | ++ |
| 8909/8910 | D12S/R136Q/R139K/A517P/G603Q/L630M/A642V/V756C | + | +++ |
| 8919/8920 | R136Q/R139K/A517P/G603Q/L630M/A642V/V756C | + | +++ |
| 8953/8954 | D12N/R136Q/T199A/R208K/A517P/G603E/A642V/V756C | − | ++ |
| 9035/9036 | D12S/R136Q/R139K/A517P/G603E/L630M/A642V/V756C | − | +++ |
| 9079/9080 | D12N/R136Q/R139K/A517P/L630M/A642V/V756C | + | +++ |
| 9101/9102 | A25E/L176M/Q198R/S532Y/S539R | − | ++ |
| 9105/9106 | L116F/S142N/Q198R/Y434H/P440R | − | ++ |

[a]Levels of increased production were determined relative to the reference polypeptide of SEQ ID NO: 8420, and defined as follows: "−" = production less than that of the reference polypeptide; "+" = production at least that of the reference polypeptide, but less than 3-fold; "++" = production at least 3-fold, but less than 13-fold; and "+++" = production at least 13-fold increased, relative to that of the reference polypeptide.

Example 43

Beta-1,2-ADP-Glycosyltransferase Variants of SEQ ID NO: 1054

In this Example, experiments for evolution and screening of GT polypeptides (β1,2GT) derived from SEQ ID NO: 1054, for improved glucosylation of steviol glycosides using ADP-glucose are described. Directed evolution of the GT encoded by SEQ ID NO: 1053 was carried out by constructing libraries in which mutations associated with improved activity in previous rounds were recombined. These libraries were then plated, grown, and screened using the high-throughput (HTP) assay described below to provide a fifth round ("Round 5") of 26 engineered GT variant polypeptides with glucosyltransferase activity toward ADP-glucose and steviol glycosides.

TABLE 43.1

β1,2GT Round 5 Variants and RebD Levels

| SEQ ID NO: (nt/aa) | Amino Acid Differences (Relative to SEQ ID NO: 1054) | Increased RebD[a] |
|---|---|---|
| 2595/2596 | E24L/N162R/P175S/M201G/D275Q/I316V | + |
| 2597/2598 | E24L/W226V/P330Q/L351M/K403R | + |
| 2599/2600 | E24L/N162R/E198P/M201G/T211E/W226V/L323V/L351M | + |
| 2601/2602 | E24L/P175S/M201G/D275Q/I316V/L351M | + |
| 2603/2604 | E24L/M201G/W226V/G253D/L402I/K403R/I406M | ++ |
| 2605/2606 | P175S/E198P/M201G/T211E/W226V/T260V/S264A/L323V/L402I/I406M | +++ |
| 2607/2608 | E24L/P175S/M201G/I316V | + |
| 2609/2610 | E24L/P175S/T211E/I316V/P330Q | + |
| 2611/2612 | E24L/P175S/T211E/G253D/I316V | ++ |
| 2613/2614 | E24L/E198P/M201G/T211E | ++ |
| 2615/2616 | E24L/P175S/W226V/L323V/L351M | + |
| 2617/2618 | E24L/E198P/M201G | + |

TABLE 43.1-continued

β1,2GT Round 5 Variants and RebD Levels

| SEQ ID NO: (nt/aa) | Amino Acid Differences (Relative to SEQ ID NO: 1054) | Increased RebD[a] |
|---|---|---|
| 2619/2620 | E24L/M201G/T211E/G253D/L323V/L351M/Q366H/D389E/L402I/K403R | + |
| 2621/2622 | E24L/P175S/T211E/C220L/T260V/D275Q/P330Q/D389E | + |
| 2623/2624 | E24L/E198P/M201G/T211E/C220L/T260V | +++ |
| 2625/2626 | P175S/E198P/W226V/T260V/L351M/L402I/K403R/I406M | ++ |
| 2627/2628 | E24L/E198P/M201G/W226V/P330Q/D389E | ++ |
| 2629/2630 | E24L/N32S/P175S/W226V/G253D/D275Q/I316V | + |
| 2631/2632 | E24L/N32S/P175S/T211E/T260V/P330Q/K403R/I406M | + |
| 2633/2634 | E24L/N162R/M201G/G253D/S264A/L351M/L402I/I406M | ++ |
| 2635/2636 | E24L/E198P/M201G/L351M | ++ |
| 2637/2638 | E24L/N162R/E198P/M201G/W226V/L351M | +++ |
| 2639/2640 | E24L/N162R/P175S/E198P/T211E/W226V/D275Q/I316V/L323V/D389E | + |
| 2641/2642 | E24L/P175S/E198P/T211E/W226V/G253D/I316V | +++ |
| 2643/2644 | E24L/E198P/M201G/C220L/D275Q/D389E/L402I/I406M | ++ |
| 2645/2646 | E24L/N32S/M201G/W226V/T260V/S264A/P330Q/L402I/I406M | +++ |

[a]Levels of increased production were determined relative to the reference polypeptide of SEQ ID NO: 1054, and defined as follows: "+" = production at least 4.1-fold, but less than 4.58-fold; "++" = at least 4.58-fold, but less than 5.17-fold; and "+++" at least 5.17-fold increased production, as compared to the reference polypeptide.

Shake Flask Powder Characterization Assay and Analysis for Glucosyl Transfer from ADP-Glucose to Rebaudioside A A shake flask powder loading dose response experiment was performed to characterize activity of the engineered round 5 variants on rebaudioside A. Levels of 0.006-0.2 g/L shake flask powder (SFP) were added to a 100 μL total reaction volume containing 50 mM potassium phosphate buffer, pH 7, 3 mM MgCl$_2$, 1 mM rebaudioside A, and 1 mM ADP-glucose. The reaction was performed at 50° C. in a Thermotron® titre-plate shaker at 300 RPM for 1 h. The reaction was diluted 1:5 in water and then quenched by adding 25 μL of the diluted assay to 75 μL acetonitrile with 0.2% formic acid and precipitated by centrifugation at 4° C. for 10 m. The supernatant was diluted 1:5 in water and analyzed for steviol glycosides by RapidFire SPE-MS/MS. The activities of the round 5 variants on rebaudioside A at 0.05 g/L SFP loading are listed in Table 43.2. All 6 of the variants listed in Table 43.2 had higher activities than SEQ ID NO: 1054. The variant with the mutations E24L, N162R, E198P, M201G, T211E, W226V, L323V, and L351M (SEQ ID NO: 2600) and its encoding polynucleotide (SEQ ID NO: 2599) were selected for further directed evolution for the glucosylation of rebaudioside A.

TABLE 43.2

β1,2GT Round 5 SFP Variants and RebD Levels

| SEQ ID NO: (nt/aa) | Amino Acid Differences (Relative to SEQ ID NO: 1054) | Increased RebD[a] |
|---|---|---|
| 2595/2596 | E24L/N162R/P175S/M201G/D275Q/I316V | ++ |
| 2599/2600 | E24L/N162R/E198P/M201G/T211E/W226V/L323V/L351M | +++ |
| 2605/2606 | P175S/E198P/M201G/T211E/VV226V/T260V/S264A/L323V/L402I/I406M | +++ |
| 2623/2624 | E24L/E198P/M201G/T211E/C220L/T260V | + |
| 2633/2634 | E24L/N162R/M201G/G253D/S264A/L351M/L402I/I406M | + |
| 2637/2638 | E24L/N162R/E198P/M201G/W226V/L351M | ++ |

[a]Levels of increased production were determined relative to the reference polypeptide of SEQ ID NO: 1054, and defined as follows: "+" = production at least 8.75-fold, but less than 10-fold; "++" = at least 10-fold, but less than 11-fold; and "+++" at least 11-fold increased production, relative to the reference polypeptide.

Example 44

Glycosyltransferase Variants of SEQ ID NO: 1002 for Glucosylation of Rebaudioside I to Rebaudioside M In this Example, experiments for evolution and screening of GT polypeptides derived from SEQ ID NO: 1002 for improved glucosylation of steviol glycosides are described. Directed evolution of the GT encoded by SEQ ID NO: 1001 was carried out by constructing libraries of variant genes in which mutations associated with improved glycosyltransferase activity toward rebaudioside I in previous rounds were recombined. These libraries were then plated, grown, and screened using the high-throughput (HTP) assay described below to provide a round (Round 5 RebI) of engineered GT variant polypeptides with glucosyltransferase activity toward UDP-glucose and rebaudioside I.

HTP Assay for Glucose/Transfer from UDP-Glucose to Rebaudioside I

Cells were lysed with 250 lysis buffer. Assays were performed on 96-well plates of cleared E. coli culture lysates expressing SEQ ID NO: 1002 variants with lysate loading of 25 μL lysate in 100 μL reactions and with substrate loading of 1 mM rebaudioside I and co-substrate loading of 1 mM UDP-glucose (Sigma, >98% purity). The following reaction conditions were used: 50 mM KPhos buffer, pH7, 3 mM MgCl$_2$, 40° C. in a Thermotron® titre-plate shaker with 300 RPM shaking for 18h. The reactions were quenched by adding 10 μL of the assay to 90 μL acetonitrile with 0.2% formic acid. The resulting mixture was precipitated by centrifugation at 4° C. for 10 m. The supernatants were diluted 1:5 in water and analyzed by LC-MS/MS as described in Table 44.1. Glycosyltransferase variant polypeptides that produced rebaudioside M from rebaudioside I with UDP-glucose, at greater quantities than SEQ ID NO: 1002 were identified. The engineered polypeptides are listed in Table 44.2.

TABLE 44.1

HPLC-MS/MS Analysis of Steviol Glycosides for Rebaudioside I Products.

| Instrument | Agilent HPLC 1200 series, Sciex 4000 QTrap |
|---|---|
| Column | Poroshell 120 EC C18 50 × 3.0 mm, 2.7 μm with Poroshell 120 EC C18 5 × 3.0, 2.7 μm guard column (Agilent Technologies) |
| Mobile phase | Gradient (A: 0.1% formic acid in water, B: 0.1% formic acid in methanol) |

| Time (m) | % B |
|---|---|
| 0 | 40 |
| 0.50 | 53 |
| 5.00 | 53 |

TABLE 44.1-continued

HPLC-MS/MS Analysis of Steviol Glycosides for Rebaudioside I Products.

|  |  |  |
|---|---|---|
|  | 5.50 | 70 |
|  | 7.5 | 70 |
|  | 8.00 | 95 |
|  | 8.50 | 95 |
|  | 8.51 | 60 |
|  | 9.20 | 40 |
| Flow rate | 0.8 mL/m | |
| Run time | 9.2 m | |
| Peak retention times | Rebaudioside M: 4.37 m | |
|  | Rebaudioside I: 6.70 m | |
|  | Other glucosylated rebaudioside I product: 4.8 m | |
|  | Second glucosylated rebaudioside I product: 6.7 m | |
| Column temperature | 40° C. | |
| Injection volume | 10 µL | |
| MS detection | MRM 990/828 (for steviol tetraglycosides, e.g., rebaudioside A), 1152/828 (for steviol pentaglycosides, e.g., rebaudioside D), 1314/828 (steviol hexaglycosides, e.g., rebaudioside M), 828/666 (for steviol triglycosides, e.g., stevioside), 666/504 (steviol diglycosides, e.g., rubusoside) | |
| MS conditions | MODE: MRM; CUR: 30; IS: 4750; CAD: high; TEM: 550° C.; GS1: 50; GS2: 50; DP: 150; EP: 10; CXP: 14; DT: 50 ms for each transition. For the first three transitions CE: 85; for the last two transitions CE: 60. | |

TABLE 44.2

β1,2GT Round 5 RebI Variants and RebM Levels

| SEQ ID NO: (nt/aa) | Amino Acid Differences (Relative to SEQ ID NO: 1002) | Increased RebM[a] |
|---|---|---|
| 2647/2648 | F156R | + |
| 2649/2650 | F156R/K161S | + |
| 2651/2652 | F156R/G199H/N200A | + |
| 2653/2654 | F156R/K161S/N162G | + |
| 2663/2664 | F156R/K161S/N162G | ++ |
| 2665/2666 | F156R/N162G/G199H | ++ |
| 2667/2668 | W21Y/L127H/P129A/K161S/N162G | +++ |
| 2669/2670 | L127Q/P129A/K161S/G199H/N200A | +++ |
| 2671/2672 | L127H/P129A/N162T | + |
| 2673/2674 | F156R/K161S/N162G | + |
| 2675/2676 | L127Q/P129A/K161S/N162G/G199H | +++ |
| 2677/2678 | F156R/K161S/N162G | ++ |
| 2679/2680 | W21Y/L127H/P129A/N162T/G199H/N200A | +++ |
| 2681/2682 | F156R/K161S/N162T | ++ |
| 2683/2684 | W21Y/L127H/P129A/K1615 | ++ |

[a]Levels of increased production were determined relative to the reference polypeptide of SEQ ID NO: 1002, and defined as follows: "+" = production at least 2.5-fold, but less than 3.13-fold; "++" = at least 3.13-fold, but less than 3.28-fold; and "+++" at least 3.28-fold increased production, as compared to the reference polypeptide.

Example 45

Beta-1,2-ADP-Glycosyltransferase Variants of SEQ ID NO: 2600

In this Example, experiments for evolution and screening of GT polypeptides derived from SEQ ID NO: 2600 for improved glucosylation of steviol glycosides using ADP-glucose are described. Directed evolution of the GT encoded by SEQ ID NO: 2599 was carried out by constructing libraries of variant genes. Libraries recombined mutations associated with the surface residues of the enzyme and beneficial mutations associated with improved activity in previous rounds, combinatorially incorporated diversity from homologs in publicly available databases, or subjected certain structural features of the enzyme with saturation mutagenesis. These libraries were then plated, grown, and screened using the high-throughput (HTP) assay described below to provide a sixth round ("Round 6") of engineered GT variant polypeptides with glucosyltransferase activity toward ADP-glucose and steviol glycosides. Twenty-four engineered variants were identified from the recombined beneficial mutations and homolog diversity (Table 45.1), and 21 were identified from saturation mutagenesis (Table 45.2).

HTP Assay for Glucose Transfer from ADP-Glucose to Rebaudioside A

Assays were performed on 96-well plates of cleared *E. coli* culture lysates expressing SEQ ID NO: 2600 variants. Lysis buffer volume was 400 µL, and the lysate was diluted 40-fold. Assays were conducted with 10 µL diluted lysate in 100 µL reaction volume with substrate loading of 1 mM rebaudioside A (>97% purity) and co-substrate loading of 1 mM ADP-glucose (Sigma, >93% purity). The following reaction conditions were used: 50 mM potassium phosphate buffer, pH 7, 3 mM MgCl$_2$, 45° C. in a Thermotron® titre-plate shaker with 300 RPM shaking for 1 h. The reactions were diluted 1:5 in water and then quenched by adding 25 µL of the diluted assay to 75 µL acetonitrile with 0.2% formic acid. The resulting mixture was precipitated by centrifugation at 4° C. for 10 m. The supernatants were diluted 1:5 in water and analyzed by RapidFire SPE-MS/MS. The engineered variants that produced rebaudioside D from rebaudioside A with ADP-glucose and that were identified from the combinatorial libraries are listed in Table 45.1. The top 84 variants from the saturation mutagenesis library were retested in triplicate as described above at 50° C. The resulting engineered GT variant polypeptides are listed in Table 45.2. Shake-flask scale cultures were grown, lysed, and lyophilized to powder for variants listed in Table 45.3.

TABLE 45.1

β1,2GT Round 6 Combinatorial Variants and RebD Levels

| SEQ ID NO: (nt/aa) | Amino Acid Differences (Relative to SEQ ID NO: 2600) | Increased RebD[a] |
|---|---|---|
| 2685/2686 | A12S/R15K/I57K/E318D/L402I/A435V | + |
| 2687/2688 | I57K/T260V/E400Q/L402I/D404S | + |
| 2689/2690 | I57K/L402I | + |
| 2691/2692 | A12S/P175S/E400Q/L402I/I406M | ++ |
| 2693/2694 | I57K/E400Q/L402I | + |
| 2695/2696 | I57K/P175S/C220L/T260V/S264A/L402I | ++ |
| 2697/2698 | A12S/I57K/P175S/K451N | + |
| 2699/2700 | H7E/Al2S/E400Q/A435V | + |
| 2701/2702 | A12S/E318D/L402I/D404S/K451N | ++ |
| 2703/2704 | A12S/R15K/I57K/V71I/P175S/T260V/E400Q/L402I | +++ |
| 2705/2706 | A12S/E318D/L402I/D404S/I406M/K451N | +++ |
| 2707/2708 | A12S/P175S/T260V/S264A/E318D/E400Q | +++ |
| 2709/2710 | A12S/R15K/E318D/E400Q/L402I/I406M | + |
| 2711/2712 | T260V | + |
| 2713/2714 | I57K/P175S/D404G | ++ |
| 2715/2716 | E400Q/L402I | ++ |
| 2717/2718 | H2-/H7E/A12S/R15K/P175S/T260V/E318D | +++ |
| 2719/2720 | R15K/P175S/E318D/E400Q/L402I | ++ |
| 2721/2722 | I57K/C220L/T260V/E400Q/L402I/I406M | +++ |
| 2723/2724 | A12S/R15K/I57K/C220L/T254K/T260V/E318D/L402I | + |
| 2725/2726 | H7E/E318D/K451N | + |
| 2727/2728 | L160V/F186M/R195P | ++ |
| 2729/2730 | R195P | + |
| 2731/2732 | L152V/E192D/R195P | + |

[a]Levels of increased production were determined relative to the reference polypeptide of SEQ ID NO: 2600, and defined as follows: "+" = production at least 1.4-fold, but less than 1.64-fold; "++" = at least 1.64-fold, but less than 1.84-fold; and "+++" at least 1.84-fold increased production, as compared to the reference polypeptide.

TABLE 45.2

β1,2GT Round 6 Saturation Mutagenesis Variants and RebD Levels

| SEQ ID NO: (nt/aa) | Amino Acid Differences (Relative to SEQ ID NO: 2600) | Increased RebD[a] |
|---|---|---|
| 2733/2734 | T240A | +++ |
| 2735/2736 | I239F | + |
| 2737/2738 | R331S | + |
| 2739/2740 | S148A | ++ |
| 2741/2742 | T240P | +++ |
| 2743/2744 | I239E | + |
| 2745/2746 | A327V | +++ |
| 2747/2748 | V323L | + |
| 2749/2750 | V135A | ++ |
| 2751/2752 | F326M | ++ |
| 2753/2754 | L152V | +++ |
| 2755/2756 | F356G | ++ |
| 2757/2758 | F186V | + |
| 2759/2760 | N32R | ++ |
| 2761/2762 | D237T | + |
| 2763/2764 | H325R | + |
| 2765/2766 | R331H | + |
| 2767/2768 | P330A | ++ |
| 2769/2770 | H325G | + |
| 2771/2772 | I239Y | + |
| 2773/2774 | R331C | + |

[a]Levels of increased production were determined relative to the reference polypeptide of SEQ ID NO: 2600, and defined as follows: "+" = production at least 1.18-fold, but less than 1.4-fold; "++" = at least 1.4-fold, but less than 1.6-fold; and "+++" at least 1.6-fold increased production, as compared to the reference polypeptide.

Shake Flask Powder Characterization Assay and Analysis for Glucosyl Transfer from ADP-Glucose to Rebaudioside A A shake flask powder loading dose response experiment was performed to characterize activity of the engineered round 6 variants on rebaudioside A. The experiment was performed as described in Example 40, with levels of 0.003-0.1 g/L SFP. The conversions of the round 6 variants on rebaudioside A at 0.025 g/L SFP loading are listed in Table 45.3. All 5 of the variants listed in Table 45.3 had higher activities than SEQ ID NO: 2600. The variant with the mutations H2-, H7E, A12S, R15K, P175S, T260V, and E318D (SEQ ID NO: 2718) and its encoding polynucleotide (SEQ ID NO: 2717) were selected for further directed evolution for the glucosylation of rebaudioside A.

TABLE 45.3

β1,2GT Round 6 Shake Flask Powder Variants and RebD Levels

| SEQ ID NO: (nt/aa) | Amino Acid Differences (Relative to SEQ ID NO: 2600) | Increased RebD[a] |
|---|---|---|
| 2687/2688 | I57K/T260V/E400Q/L402I/D404S | + |
| 2695/2696 | I57K/P175S/C220L/T260V/S264A/L402I | + |
| 2703/2704 | A12S/R15K/I57K/V71I/P175S/T260V/E400Q/L402I | + |
| 2717/2718 | H2-/H7E/A12S/R15K/P175S/T260V/E318D | ++ |
| 2727/2728 | L160V/F186M/R195P | + |

[a]Levels of increased production were determined relative to the reference polypeptide of SEQ ID NO: 2600, and defined as follows: "+" = production at least 1.1-fold, but less than 1.6-fold; and "++" = at least 1.6-fold increased production, as compared to the reference polypeptide.

Example 46

Beta-1,2-ADP-Glycosyltransferase Variants of SEQ ID NO: 2718

In this Example, experiments for evolution and screening of GT polypeptides derived from SEQ ID NO: 2718 for improved glucosylation of steviol glycosides using ADP-glucose are described. Directed evolution of the GT encoded by SEQ ID NO: 2717 was carried out by constructing combinatorial libraries of variant genes in which beneficial mutations associated with improved activity or expression in previous rounds were recombined. Another library subjected certain structural features of the enzyme to saturation mutagenesis. These libraries were then plated, grown, and screened using the high-throughput (HTP) assay described below to provide a seventh round ("Round 7") of engineered GT variant polypeptides with glucosyltransferase activity toward ADP-glucose and steviol glycosides. Twenty-five engineered variants were identified from the recombined beneficial mutations (Table 46.1) and 29 engineered variants were identified from saturation mutagenesis (Table 46.2).

HTP Coupled Assay for Glucose Transfer from Sucrose to ADP to Rebaudioside A

Assays were performed on 96-well plates of cleared E. coli culture lysates expressing SEQ ID NO: 2717 variants. Lysis buffer volume was 400 μL, and the lysate was diluted 10-fold. For screening the library in which beneficial mutations from previous rounds were recombined, assays were conducted with 10 μL diluted lysate and 0.2 g/L SUS SFP SEQ ID NO: 1392 in 100 μL reaction volume with substrate loading of 7.5 mM rebaudioside A and co-substrate loadings of 1 mM ADP (Sigma, >95%) and 15 mM sucrose (Sigma). The following reaction conditions were used: 50 mM potassium phosphate buffer, pH6.5, 50° C. in Thermotron® titre-plate shaker with 300 RPM shaking for 2h. The reactions were diluted 1:10 in water and then quenched by adding 10 μL of the diluted assay to 90 μL acetonitrile with 0.2% formic acid. The resulting mixture was precipitated by centrifugation at 4° C. for 10 m. The supernatants were diluted 1:10 in water and analyzed by RapidFire SPE-MS/MS as described in Table 31.1. For the remaining two round 7 libraries, screening was performed as described above, with the exceptions that 0.2 g/L SUS SFP SEQ ID NO: 1456 SFP and 30 mM sucrose were used. The engineered variants with glucosyltransferase activity coupled with a SuS on rebaudioside A from the recombined beneficial mutations are listed in Table 46.1. The top variants from the saturation mutagenesis library were retested in triplicate, using the procedure described above with the exceptions that 0.8 mM ADP was used, and the reactions were diluted 1:20 in water and then quenched by adding 20 μL of the diluted assay to 80 μL acetonitrile with 0.2% formic acid. The resulting engineered GT variant polypeptides are listed in Table 46.2. Shake-flask scale cultures were grown, lysed, and lyophilized to powder for variants listed in Table 46.3.

TABLE 46.1

β1,2GT Round 7 Combinatorial Variants and RebD Levels

| SEQ ID NO: (nt/aa) | Amino Acid Differences (Relative to SEQ ID NO: 2718) | Increased RebD[a] |
|---|---|---|
| 2775/2776 | F185M/R194P/D236T/T239A/F325M/A326V | ++ |
| 2777/2778 | K14R/M184A/F185M/R194P/D388E/E399Q/L401I | +++ |
| 2779/2780 | K14R/R194P | ++ |
| 2781/2782 | K14R/M184A/F185M/R194P/F234Y/F325M/A326V/P329A | +++ |
| 2783/2784 | K14R/A326V/R330H | +++ |
| 2785/2786 | K14R/N31R/M184A/D274Q/V322L/A326V/P329A/R330H | + |
| 2787/2788 | K14R/F355G | ++ |
| 2789/2790 | K14R/I56K/M184A/F185M/R194P/I238M/T239A/D274Q/P329A/E399Q | +++ |
| 2791/2792 | K14R/F185M/D236T/I238M/T239A/D274Q/V322L/A326V/P329Q/F355G/E399Q/L401I | ++ |
| 2793/2794 | K14R/F185M/R194P/I238M/E399Q | + |
| 2795/2796 | K14R/L23Q/D274Q/A326V/P329A | + |

TABLE 46.1-continued

β1,2GT Round 7 Combinatorial Variants and RebD Levels

| SEQ ID NO: (nt/aa) | Amino Acid Differences (Relative to SEQ ID NO: 2718) | Increased RebD[a] |
|---|---|---|
| 2797/2798 | N31R/I56K/I315V/P329A/R330H | + |
| 2799/2800 | K14R/I56K/M184A/R194P/F234Y/I315V/A326V/P329Q/E399Q/L401I | ++ |
| 2801/2802 | KI4R/V322L/A326R/R330H | + |
| 2803/2804 | S147A/D236T/I238M/D243G/I315V/P329A/R330H/E399Q/L401I | + |
| 2805/2806 | K14R/M184A/R194P/F355G/E399Q | ++ |
| 2807/2808 | K14R/I56K/G252D/D274Q/I315V/A326V/P329A/R330H/L401I | + |
| 2809/2810 | L23Q/N31R/S147A/M184A/F185M/I238M/G252D/F325M/P329A/R330H/D388E/L401I | ++ |
| 2811/2812 | K14R/F355G/E399Q | + |
| 2813/2814 | K14R/I56K/R194P/I238M/I315V/F325M/A326V/P329A/R330H/E399Q | ++ |
| 2815/2816 | I238M | + |
| 2817/2818 | E65D/I238T/N240S | + |
| 2819/2820 | E65D | + |
| 2821/2822 | E65D/Q114E/H132R/I238M | + |
| 2823/2824 | S223T/I412S | + |

[a]Levels of increased production were determined relative to the reference polypeptide of SEQ ID NO: 2718, and defined as follows: "+" = production at least 1.05-fold, but less than 2.5-fold; "++" = at least 2.5-fold, but less than 3-fold; and "+++" at least 3-fold increased production, as compared to the reference polypeptide.

TABLE 46.2

β1,2GT Round 7 Saturation Mutagenesis Variants and RebD Levels

| SEQ ID NO: (nt/aa) | Amino Acid Differences (Relative to SEQ ID NO: 2718) | Increased RebD[a] |
|---|---|---|
| 2825/2826 | N391R | ++ |
| 2827/2828 | K309E | ++ |
| 2829/2830 | E65N | +++ |
| 2831/2832 | M104L | + |
| 2833/2834 | K422R | + |
| 2835/2836 | I56T | + |
| 2837/2838 | K58R | + |
| 2839/2840 | S11G | +++ |
| 2841/2842 | L45V | ++ |
| 2843/2844 | N138G | ++ |
| 2845/2846 | N135L | ++ |
| 2847/2848 | N138K | +++ |
| 2849/2850 | H132Q | ++ |
| 2851/2852 | K309H | + |
| 2853/2854 | E430L | ++ |
| 2855/2856 | S11Q | +++ |
| 2857/2858 | E165P | + |
| 2859/2860 | Y449F | + |
| 2861/2862 | N286R | +++ |
| 2863/2864 | Q114R | + |
| 2865/2866 | E256P | + |
| 2867/2868 | E430V | + |
| 2869/2870 | I55L | + |
| 2871/2872 | H132S | + |
| 2873/2874 | I238G | + |
| 2875/2876 | L113V | + |
| 2877/2878 | E273R | + |
| 2879/2880 | E65S | ++ |
| 2881/2882 | L45F | ++ |

[a]Levels of increased production were determined relative to the reference polypeptide of SEQ ID NO: 2718, and defined as follows: "+" = production at least that of the reference polypeptide, but less than 1.3-fold; "++" = at least 1.3-fold, but less than 1.7-fold; and "+++" at least 1.7-fold increased production, as compared to the reference polypeptide.

Shake Flask Powder Characterization Assay and Analysis for Glucosyl Transfer from ADP-Glucose to Rebaudioside A A shake flask powder loading dose response experiment was performed to characterize activity of the engineered round 7 variants on rebaudioside A. Levels of 0.002-0.2 g/L shake flask powder (SFP) were added to a 100 μL total reaction volume containing 50 mM potassium phosphate buffer, pH 6.5, 2 mM rebaudioside A, and 2 mM ADP-glucose. The reaction was performed at 50'C in a Thermotron® titre-plate shaker at 300 RPM for 1h. The reaction was diluted 1:5 in water and then quenched by adding 25 μL of the diluted assay to 75 μL acetonitrile with 0.2% formic acid and precipitated by centrifugation at 4° C. for 10 m. The supernatant was diluted 1:10 in water and analyzed for steviol glycosides by RapidFire SPE-MS/MS. The conversions of the round 7 variants on rebaudioside A at 0.025 g/L SFP loading are shown in Table 46.3. All 7 of the variants listed in Table 46.3 had higher activities than SEQ ID NO: 2718. The variant with the mutations K14R, I56K, R194P, 1I238M, 1I315V, F325M, A326V, P329A, R330H, and E399Q (SEQ ID NO: 2814) and its encoding polynucleotide (SEQ ID NO: 2813) were selected for further directed evolution for the glucosylation of rebaudioside A.

TABLE 46.3

β1,2GT Round 7 Shake Flask Powder Variants and RebD Levels

| SEQ ID NO: (nt/aa) | Amino Acid Differences (Relative to SEQ ID NO: 2718) | Increased RebD[a] |
|---|---|---|
| 2777/2778 | K14R/M184A/F185M/R194P/D388E/E399Q/L401I | ++ |
| 2793/2794 | K14R/F185M/R194P/I238M/E399Q | ++ |
| 2799/2800 | K14R/I56K/M184A/R194P/F234Y/I315V/A326V/P329Q/E399Q/L401I | + |
| 2805/2806 | K14R/M184A/R194P/F355G/E399Q | + |
| 2809/2810 | L23Q/N31R/S147A/M184A/F185M/I238M/G252D/F325M/P329A/R330H/D388E/L401I | +++ |
| 2811/2812 | K14R/F355G/E399Q | ++ |
| 2813/2814 | K14R/I56K/R194P/I238M/I315V/F325M/A326V/P329A/R330H/E399Q | +++ |

[a]Levels of increased production were determined relative to the reference polypeptide of SEQ ID NO: 2718, and defined as follows:
"+" = production at least 1.6-fold, but less than 2.3-fold;
"++" = at least 2.3-fold, but less than 2.5-fold; and
"+++" at least 2.5-fold production, as compared to the reference polypeptide.

Example 47

Beta-1,2-ADP-Glycosyltransferase Variants of SEQ ID NO: 2814

In this Example, experiments for evolution and screening of GT polypeptides derived from SEQ ID NO: 2814 for improved glucosylation of steviol glycosides using ADP-glucose are described. Directed evolution of the GT encoded by SEQ ID NO: 2813 was carried out by constructing combinatorial libraries of variant genes in which beneficial mutations associated with improved activity in previous rounds were recombined and in which certain structural features of the enzyme were subjected with saturation mutagenesis. These libraries were then plated, grown, and screened using the high-throughput (HTP) assay described below to provide an eighth round ("Round 8") of engineered GT variant polypeptides with glucosyltransferase activity toward ADP-glucose and steviol glycosides. Sixteen engineered variants were identified from the recombined beneficial mutations (Table 47.1), and 18 were identified from saturation mutagenesis (Table 47.2).

HTP Coupled Assay for Glucose Transfer from Sucrose to ADP to Rebaudioside A

Assays were performed on 96-well plates of cleared E. coli culture lysates expressing SEQ ID NO: 2813 variants. Lysis buffer volume was 400 μL, and the lysate was diluted 20-fold. For screening the library in which beneficial mutations from previous rounds were recombined, assays were conducted with 10 μL diluted lysate and 0.2 g/L SUS SFP SEQ ID NO: 1456 in 100 µL reaction volume with substrate loading of 7.5 mM rebaudioside A and co-substrate loadings of 0.4 mM ADP (Sigma, >95%) and 30 mM sucrose (Sigma). The following reaction conditions were used: 50 mM potassium phosphate buffer, pH 6.5, 50° C. in a Thermotron® titre-plate shaker with 300 RPM shaking for 1 h. The reactions were diluted 1:20 in water and then quenched by adding 20 µL of the diluted assay to 80 µL acetonitrile with 0.2% formic acid. The resulting mixture was precipitated by centrifugation at 4° C. for 10 m. The supernatants were diluted 1:10 in water and analyzed by RapidFire SPE-MS/MS. The resulting engineered variants with glucosyltransferase activity coupled with a SuS on rebaudioside A are listed in Table 47.1. For the round 8 saturation mutagenesis library, screening was performed as described above with the exceptions that 0.2 g/L SUS SFP SEQ ID NO: 1582, 0.2 mM ADP, and the following reaction conditions were used: 50 mM potassium phosphate buffer, pH 6, 55° C. in a Thermotron® titre-plate shaker with 300 RPM shaking for 2 h. The top 56 variants from this library were retested in triplicate using the same assay conditions with the exception that 0.15 g/L SUS SFP SEQ ID NO: 1582 was used. The resulting engineered GT variant polypeptides are listed in Table 47.2. Shake-flask scale cultures were grown, lysed, and lyophilized to powder for variants listed in Table 47.3.

TABLE 47.1

β1,2GT Round 8 Combinatorial Variants and RebD Levels

| SEQ ID NO: (nt/aa) | Amino Acid Differences (Relative to SEQ ID NO: 2814) | Increased RebD[a] |
|---|---|---|
| 2883/2884 | N31R/D388E | ++ |
| 2885/2886 | M238Y/H324G/A329Q/F355G | ++ |
| 2887/2888 | N31R/V134A/F185M/G252D/D274Q/H324G/D388E | +++ |
| 2889/2890 | L23Q/N31R/F185M/H324G/L401I | + |
| 2891/2892 | N31R/V134A/G252D/H324G | + |
| 2893/2894 | N31R/V134A/M238E/G252D/V322L/H324G/D388E | ++ |
| 2895/2896 | H324G/A329Q/F355G/L401I | + |
| 2897/2898 | V134A/M184A/F185M/F234Y/D236T/T239A/D274Q/H324G/D388E | +++ |
| 2899/2900 | N31R/V322L | ++ |
| 2901/2902 | D236T | + |
| 2903/2904 | F234Y/D236T/M238E/V322L/H324G/F355G | +++ |
| 2905/2906 | V322L/H324G | + |
| 2907/2908 | M184A/F185M/V322L | + |
| 2909/2910 | N31R/D236T | + |
| 2911/2912 | L23Q/N31R/F185M/F355G | + |
| 2913/2914 | N31R/M184A/F185M/M238Y/T239A/V322L | + |

[a]Levels of increased production were determined relative to the reference polypeptide of SEQ ID NO: 2814, and defined as follows:
"+" = production at least 1.3-fold that of the reference polypeptide, but less than 1.4-fold;
"++" = at least 1.4-fold but less than 1.7-fold; and
"+++" = greater than 1.7-fold increased production, as compared to the reference polypeptide.

TABLE 47.2

β1,2GT Round 8 Saturation Mutagenesis Variants and RebD Levels

| SEQ ID NO: (nt/aa) | Amino Acid Differences (Relative to SEQ ID NO: 2814) | Increased RebD[a] |
|---|---|---|
| 2915/2916 | I427R | + |
| 2917/2918 | S426R | +++ |
| 2919/2920 | V164H | ++ |
| 2921/2922 | I440R | ++ |
| 2923/2924 | M325L | +++ |
| 2925/2926 | V176R | +++ |
| 2927/2928 | V164R | + |
| 2929/2930 | S446R | ++ |
| 2931/2932 | T400V | ++ |
| 2933/2934 | I122L | + |
| 2935/2936 | S426A | +++ |
| 2937/2938 | V164M | + |
| 2939/2940 | V176K | ++ |
| 2941/2942 | V176N | + |
| 2943/2944 | V176L | + |
| 2945/2946 | E177A | + |
| 2947/2948 | G316R | + |
| 2949/2950 | K425R | + |

[a]Levels of increased production were determined relative to the reference polypeptide of SEQ ID NO: 2814, and defined as follows:
"+" = production at least that of the reference polypeptide, but less than 1.25-fold;
"++" = at least 1.25-fold, but less than 1.35-fold; and
"+++" = at least 1.35-fold increased production, as compared to the reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 8 variants on rebaudioside A. Levels of 0.002-0.2 g/L shake flask powder (SFP) were added to a 100 µL total reaction volume containing 50 mM potassium phosphate buffer, pH 6.5, 8 mM rebaudioside A, 0.4 mM ADP, 30 mM sucrose, and 0.2 g/L SUS SFP SEQ ID NO: 1456. The reaction was performed at 50° C. in a Thermotron® titre-plate shaker at 300 RPM for 1 h. The reaction was diluted 1:20 in water and then quenched by adding 20 µL of the diluted assay to 80 µL acetonitrile with 0.2% formic acid and precipitated by centrifugation at 4° C. for 10 m. The supernatant was diluted 1:10 in water and analyzed for steviol glycosides by RapidFire SPE-MS/MS. The conversion of the round 8 variants on rebaudioside A at 0.1 g/L SFP loading are shown in Table 47.3. All 8 of the variants listed in Table 47.3 had higher activities than SEQ ID NO: 2814. The variant with the mutations N31R and D388E (SEQ ID NO:2884) and its encoding polynucleotide (SEQ ID NO: 2883) were selected for further directed evolution for the glucosylation of rebaudioside A.

TABLE 47.3

β1,2GT Round 8 Shake Flask Variants and RebD Levels

| SEQ ID NO: (nt/aa) | Amino Acid Differences (Relative to SEQ ID NO: 2814) | Increased RebD[a] |
|---|---|---|
| 2883/2884 | N31R/D388E | +++ |
| 2887/2888 | N31R/V134A/F185M/G252D/D274Q/H324G/D388E | + |
| 2893/2894 | N31R/V134A/M238E/G252D/V322L/H324G/D388E | + |
| 2897/2898 | V134A/M184A/F185M/F234Y/D236T/T239A/D274Q/H324G/D388E | + |
| 2899/2900 | N31R/V322L | ++ |
| 2903/2904 | F234Y/D236T/M238E/V322L/H324G/F355G | ++ |
| 2909/2910 | N31R/D236T | + |
| 2913/2914 | N31R/M184A/F185M/M238Y/T239A/V322L | +++ |

[a]Levels of increased production were determined relative to the reference polypeptide of SEQ ID NO: 2814, and defined as follows:
"+" = production at least 1.2-fold, less than 1.7-fold;
"++" = at least 1.7-fold, but less than 1.9-fold; and
"+++" = at least 1.9-fold increased production, as compared to the reference polypeptide.

Example 48

Beta-1,2-ADP-Glycosyltransferase Variants of SEQ ID NO: 2884

In this Example, experiments for evolution and screening of GT polypeptides derived from SEQ ID NO: 2884 for improved glucosylation of steviol glycosides using ADP-glucose are described. Directed evolution of the GT encoded by SEQ ID NO: 2883 was carried out by constructing combinatorial libraries of variant genes in which beneficial mutations associated with improved activity in previous rounds were recombined. These libraries were then plated, grown, and screened using the high-throughput (HTP) assay described below to provide a ninth round ("Round 9") of 33 engineered GT variant polypeptides with glucosyltransferase activity toward ADP-glucose and steviol glycosides.

HTP Coupled Assay for Glucose Transfer from Sucrose to ADP to Rebaudioside A Assays were performed on 96-well plates of cleared *E. coli* culture lysates expressing SEQ ID NO: 2883 variants. Lysis buffer volume was 400 μL, and the lysate was diluted 20-fold. Assays were conducted with 10 μL diluted lysate and 0.15 g/L SUS SFP SEQ ID NO: 1582 in 100 μL reaction volume with substrate loading of 7.5 mM rebaudioside A and co-substrate loadings of 0.2 mM ADP (Sigma, >95%) and 24 mM sucrose (Sigma). The following reaction conditions were used: 50 mM potassium phosphate buffer, pH 6, 55° C. in a Thermotron® titre-plate shaker with 300 RPM shaking for 2 h. The reactions were diluted, quenched, and analyzed as described above. The resulting engineered variants with glucosyltransferase activity coupled with a SuS on rebaudioside A are listed in Table 48.1. Shake-flask scale cultures were grown, lysed, and lyophilized to powder for variants listed in Table 48.2.

TABLE 48.1

β1,2GT Round 9 Combinatorial Variants and RebD Levels

| SEQ ID NO: (nt/aa) | Amino Acid Differences (Relative to SEQ ID NO: 2884) | Increased RebD[a] |
|---|---|---|
| 2951/2952 | S11Q/K58R/E65N/M104L/P107G/N138G/N286R | + |
| 2953/2954 | S11G/K58R/H132Q/E165P/N286R/N391R/K422S/E430L | + |
| 2955/2956 | N135L/N138G/E165P/K309H/E430L | + |
| 2957/2958 | S11Q/E65N/M104L/P107G/N138G/E165P/N286R/N391R/E430L | ++ |
| 2959/2960 | P107G/Q114R/H132Q/N138G | + |
| 2961/2962 | S11Q/K58R | + |
| 2963/2964 | K58R/E65N/E165P/K309H/E430L | ++ |
| 2965/2966 | S11Q | + |
| 2967/2968 | S11Q/K58R/E65N/N135L/N138G | ++ |
| 2969/2970 | K58R/M104L/Q114R/E165P/N391R | + |
| 2971/2972 | S11Q/N138K/E165P/S223T/K309H | + |
| 2973/2974 | S11Q/E65N/P107G/N135L/E165P/N391R/E430L | + |
| 2975/2976 | S11Q/P107G/N138G | + |
| 2977/2978 | S11Q/E65N/N135L/N138G | + |
| 2979/2980 | S11G/E65N/H132Q/N391R/E430L | + |
| 2981/2982 | S11Q/M104L/H132Q/N138K/N391R | + |
| 2983/2984 | S11Q/Q114R/S223T/G252D/N286R/N391R | ++ |
| 2985/2986 | S11G/M104L/H132Q/N138G/K309H/N391R | ++ |
| 2987/2988 | S11G/K58R/M104L/P107G/Q114R/N138K/S223T/N391R | +++ |
| 2989/2990 | S11G/L45V/K58R/H132Q/N138G/N286R | ++ |
| 2991/2992 | S11G/P107G/Q114R/S223T/K309H/E430L | +++ |
| 2993/2994 | S11Q/H132Q/N135L/N138K/S223T/N286R | +++ |
| 2995/2996 | S223T/K309E | ++ |
| 2997/2998 | S11Q/H132Q/N138G/S223T/N286R/N391R | +++ |
| 2999/3000 | K58R/E65N/N138K | ++ |
| 3001/3002 | P107G/E430L | + |
| 3003/3004 | S11Q/K58R/N138G/K309E | +++ |
| 3005/3006 | S11G/K58R/Q114R/N286R/K309H/N391R | + |
| 3007/3008 | K58R/E65N/N138G/E165P | ++ |
| 3009/3010 | S11Q/E65N/H132Q/N135L/G252D | + |
| 3011/3012 | S11Q/Q114R/N135L/N138G/S223T | ++ |
| 3013/3014 | S11Q/K58R/E65N/P107G/N135L/S223T/N286R/N391R/E430L | + |
| 3015/3016 | S11Q/E65N/H132Q/N135L/N138G/S223T/N391R | +++ |

[a]Levels of increased production were determined relative to the reference polypeptide of SEQ ID NO: 2884, and defined as follows:
"+" = production at least 1.5-fold, but less than 2.1-fold;
"++" = at least 2.1-fold, but less than 2.5-fold; and
"+++" = at least 2.5-fold increased production, relative to reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 9 variants on rebaudioside A. Levels of 0.002-0.2 g/L shake flask powder (SFP) were added to a 100 μL total reaction volume containing 50 mM potassium phosphate buffer, pH6, 8 mM rebaudioside A, 0.4 mM ADP, 24 mM sucrose, and 0.15 g/L SUS SFP SEQ ID NO: 1582. The reaction was performed at 55° C. in a Thermotron® titre-plate shaker at 300 RPM for 1 h. The reactions were diluted, quenched, and analyzed as described above. The conversion of the round 9 variants on rebaudioside A at 0.05 g/L SFP loading are shown in Table 48.2. All 6 of the variants listed in Table 48.2 had higher activities than SEQ ID NO: 2884. The variant with the mutation S11Q, E65N, H132Q, N135L, N138G, S223T, and N391R (SEQ ID NO:3016) and its encoding polynucleotide (SEQ ID NO: 3015) were most improved and were selected for further directed evolution for the glucosylation of rebaudioside A.

TABLE 48.2

β1,2GT Round 9 Shake Flask Powder Variants and RebD Levels

| SEQ ID NO: (nt/aa) | Amino Acid Differences (Relative to SEQ ID NO: 2884) | Increased RebD[a] |
|---|---|---|
| 3015/3016 | S11Q/E65N/H132Q/N135L/N138G/S223T/N391R | +++ |
| 2983/2984 | S11Q/Q114R/S223T/G252D/N286R/N391R | ++ |
| 2997/2998 | S11Q/H132Q/N138G/S223T/N286R/N391R | + |
| 2987/2988 | S11G/K58R/M104L/P107G/Q114R/N138K/S223T/N391R | ++ |
| 3011/3012 | S11Q/Q114R/N135L/N138G/S223T | + |
| 2975/2976 | S11Q/P107G/N138G | + |

[a]Levels of increased production were determined relative to the reference polypeptide of SEQ ID NO: 2884, and defined as follows:
"+" = production at least 1.07-fold, but less than 1.2-fold;
"++" = at least 1.2-fold, but less than 1.85-fold; and
"+++" = at least 1.85-fold increased production, as compared to the reference polypeptide.

Example 49

Beta-1,2-ADP-Glycosyltransferase Variants of SEQ ID NO: 3016

In this Example, experiments for evolution and screening of GT polypeptides derived from SEQ ID NO: 3016 for improved glucosylation of steviol glycosides using ADP-glucose are described. Directed evolution of the GT encoded by SEQ ID NO: 3015 was carried out by constructing libraries of variant genes. Libraries recombined mutations associated with improved activity in previous rounds and subjected certain structural features of the enzyme with saturation mutagenesis. These libraries were then plated, grown, and screened using the high-throughput (HTP) assay described below to provide a tenth round ("Round 10") of engineered GT variant polypeptides with glucosyltransferase activity toward ADP-glucose and steviol glycosides. Forty engineered variants were identified from the recombined beneficial mutations (Table 49.1), and 40 were identified from saturation mutagenesis (Table 49.2).

HTP Coupled Assay for Glucose Transfer from Sucrose to ADP to Rebaudioside A

Assays were performed on 96-well plates of cleared E. coli culture lysates expressing SEQ ID NO: 3015 variants. Lysis buffer volume was 400 µL, and the lysate was diluted 20-fold. For screening the library in which beneficial mutations from previous rounds were recombined, assays were conducted with 10 µL diluted lysate and 0.15 g/L SUS SFP SEQ ID NO: 1764 in 100 µL reaction volume with substrate loading of 8 mM rebaudioside A and co-substrate loadings of 0.2 mM ADP (Sigma, >95%) and 24 mM sucrose. The following reaction conditions were used: 50 mM potassium phosphate buffer, pH 6, 55° C. in a Thermotron® titre-plate shaker with 300 RPM shaking for 1 h. The reactions were diluted 1:20 in water and then quenched by adding 20 µL of the diluted assay to 80 µL acetonitrile with 0.2% formic acid. The resulting mixture was precipitated by centrifugation at 4° C. for 10 m. The supernatants were diluted 1:10 in water and analyzed by RapidFire SPE-MS/MS. The resulting engineered variants with glucosyltransferase activity coupled with a SuS on rebaudioside A are listed in Table 49.1. For the round 10 saturation mutagenesis library, screening was performed as described above with the exceptions that the lysate was diluted 10-fold, and the following reaction conditions were used: 60° C. in a Thermotron® titre-plate shaker with 300 RPM shaking for 2 h. The resulting engineered GT variant polypeptides are listed in Table 49.2. Shake-flask scale cultures were grown, lysed, and lyophilized to powder for variants listed in Table 49.3.

TABLE 49.1

β1,2GT Round 10 Combinatorial Variants and RebD Levels

| SEQ ID NO: (nt/aa) | Amino Acid Differences (Relative to SEQ ID NO: 3016) | Increased RebD[a] |
|---|---|---|
| 3017/3018 | K58R/I122L/I440R | + |
| 3019/3020 | K58R/I122L/V164H/D236T/S446R | + |
| 3021/3022 | K58R/P107G/I122L/V322L/T400V/K425R/ I427R/I440R/S446R | ++ |
| 3023/3024 | K58R/P107G/D236T/T400V | + |
| 3025/3026 | I122L/V164H/V176R/H324G/T400V | +++ |
| 3027/3028 | I122L/V176R/D236T/T400V | ++ |
| 3029/3030 | P107G/V164H/D236T/T400V/S446R | ++ |
| 3031/3032 | V164H | ++ |
| 3033/3034 | K58R/V176R/D236T | +++ |
| 3035/3036 | V176R/T400V | +++ |
| 3037/3038 | K58R/P107G/I122L/D236T/H324G/T400V/ K425R/S446R | ++ |
| 3039/3040 | V164H/V322L/H324G/M325L/T400V/ K425R/I440R/S446R | + |
| 3041/3042 | I122L/T400V | +++ |
| 3043/3044 | K58R/V164H/V176R | +++ |
| 3045/3046 | P107G/I440R | + |
| 3047/3048 | P107G/I122L/D236T/K425R/S426A/S446R | +++ |
| 3049/3050 | P107G/V176R/V322L/M325L/I440R/S446R | ++ |

TABLE 49.1-continued

β1,2GT Round 10 Combinatorial Variants and RebD Levels

| SEQ ID NO: (nt/aa) | Amino Acid Differences (Relative to SEQ ID NO: 3016) | Increased RebD[a] |
|---|---|---|
| 3051/3052 | I122L/V164H/T400V/I440R | +++ |
| 3053/3054 | K58R/P107G/I122L/V176R/D236T/H324G/ M325L/T400V/S426R/I427R | + |
| 3055/3056 | I122L/V164H/T400V/I440R/S446R | + |
| 3057/3058 | K58R/P107G/T400V | + |
| 3059/3060 | H324G/T400V/K425R/S426R/I440R/S446R | ++ |
| 3061/3062 | I122L/I440R/S446R | +++ |
| 3063/3064 | V164H/S271G/K425R/S426R | ++ |
| 3065/3066 | V164H/T400V | ++ |
| 3067/3068 | P107G/D236T | ++ |
| 3069/3070 | K58R/P107G/V164H/T400V | ++ |
| 3071/3072 | K58R/I122L/M325L | + |
| 3073/3074 | K58R/I122L/V322L/M325L | ++ |
| 3075/3076 | K58R/I122L/V176R/D236T/T400V/S446R | + |
| 3077/3078 | K58R/V164H/H324G/K425R/I427R | + |
| 3079/3080 | P107G/V176R/T400V/K425R/I427R/I440R | + |
| 3083/3084 | K58R/D236T | + |
| 3085/3086 | I122L/K425R/S426R/S446R | + |
| 3087/3088 | I122L/V176R/H324G/T400V/I440R | + |
| 3089/3090 | K58R/I122L/V176R/V322L/H324G/S426A/ I427R | + |
| 3093/3094 | I139V/G252D | + |
| 3095/3096 | G8S/K448A | + |
| 3097/3098 | I139V | + |
| 3099/3100 | P189R | + |

[a]Levels of increased production were determined relative to the reference polypeptide of SEQ ID NO: 3016, and defined as follows:
"+" = production at least 1.2-fold, but less than 1.43-fold;
"++" = at least 1.43-fold, but less than 1.67-fold; and
"+++" = at least 1.67-fold increased production, as compared to the reference polypeptide.

TABLE 49.2

β1,2GT Round 10 Saturation Mutagenesis Variants and RebD Levels

| SEQ ID NO: (nt/aa) | Amino Acid Differences (Relative to SEQ ID NO: 3016) | Increased RebD[a] |
|---|---|---|
| 3101/3102 | N240E | +++ |
| 3103/3104 | A242Y | + |
| 3105/3106 | S9C | + |
| 3107/3108 | E210V | +++ |
| 3109/3110 | E408P | ++ |
| 3111/3112 | G200T | ++ |
| 3113/3114 | N115R | + |
| 3115/3116 | N172R | ++ |
| 3117/3118 | A242I | ++ |
| 3119/3120 | L116V | + |
| 3121/3122 | G415R | +++ |
| 3123/3124 | K245M | + |
| 3125/3126 | G200A | +++ |
| 3127/3128 | E411Q | + |
| 3129/3130 | A213G | + |
| 3131/3132 | G415K | ++ |
| 3133/3134 | T409L | +++ |
| 3135/3136 | N423R | +++ |
| 3137/3138 | N172S | + |
| 3139/3140 | N65S | + |
| 3141/3142 | K106A | ++ |
| 3143/3144 | Q178K | + |
| 3145/3146 | N423A | ++ |
| 3147/3148 | N447R | + |
| 3149/3150 | D255P | +++ |
| 3151/3152 | N240C | ++ |
| 3153/3154 | S9M | ++ |
| 3155/3156 | H324R/N423R | +++ |
| 3157/3158 | N447L | + |
| 3159/3160 | K416R | + |
| 3161/3162 | V385R | + |
| 3163/3164 | N115D | + |
| 3165/3166 | N240L | ++ |

TABLE 49.2-continued

β1,2GT Round 10 Saturation Mutagenesis Variants and RebD Levels

| SEQ ID NO: (nt/aa) | Amino Acid Differences (Relative to SEQ ID NO: 3016) | Increased RebD[a] |
|---|---|---|
| 3167/3168 | E210L | ++ |
| 3169/3170 | G415A | ++ |
| 3171/3172 | G200V | + |
| 3173/3174 | N240P | + |
| 3175/3176 | N240V | + |
| 3177/3178 | I412R | + |
| 3179/3180 | G415H | + |

[a]Levels of increased production were determined relative to the reference polypeptide of SEQ ID NO: 3016, and defined as follows:
"+" = production at least 1.1-fold that of the reference polypeptide, but less than 1.38-fold;
"++" = at least 1.38-fold but less than 1.76-fold; and
"+++" = at least 1.76-fold production, relative to reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 10 variants on rebaudioside A. Levels of 0.002-0.2 g/L shake flask powder (SFP) were added to a 100 µL total reaction volume containing 50 mM potassium phosphate buffer, pH 6, 8 mM rebaudioside A, 0.4 mM ADP, 24 mM sucrose, and 0.15 g/L SUS SFP SEQ ID NO: 1764. The reaction was performed at 60° C. in a Thermotron® titre-plate shaker at 300 RPM for 1 h. The reaction was diluted 1:20 in water and then quenched by adding 20 µL of the diluted assay to 80 µL acetonitrile with 0.2% formic acid and precipitated by centrifugation at 4° C. for 10 m. The supernatant was diluted 1:10 in water and analyzed for steviol glycosides by RapidFire SPE-MS/MS. The activities of the round 10 variants on rebaudioside A at 0.25 g/L SFP loading are shown in Table 49.3. All 5 of the variants listed in Table 49.3 had higher activities than SEQ ID NO: 3016. The variant with the mutations K58R, I122L, V176R, T400V, K425R, S426A, I427R, and S446R (SEQ ID NO: 3082) and its encoding polynucleotide (SEQ ID NO: 3081) were most improved and were selected for further directed evolution for the glucosylation of rebaudioside A.

TABLE 49.3

β1,2GT Round 10 Shake Flask Variants and RebD Levels

| SEQ ID NO: (nt/aa) | Amino Acid Differences (Relative to SEQ ID NO: 3016) | Increased RebD[a] |
|---|---|---|
| 3061/3062 | I122L/I440R/S446R | + |
| 3081/3082 | K58R/I122L/V176R/T400V/K425R/ S426A/I427R/S446R | ++ |
| 3089/3090 | K58R/I122L/V176R/V322L/H324G/ S426A/I427R | + |
| 3091/3092 | K448A | + |
| 3099/3100 | P189R | + |

[a]Levels of increased production were determined relative to the reference polypeptide of SEQ ID NO: 3016, and defined as follows:
"+" = production at least that of the reference polypeptide, but less than 1.3-fold; and
"++" = at least 1.3-fold increased production, as compared to the reference polypeptide.

Example 50

Beta-1,2-ADP-Glycosyltransferase Variants of SEQ ID NO: 3082

In this Example, experiments for evolution and screening of GT polypeptides derived from SEQ ID NO: 3082 for improved glucosylation of steviol glycosides using ADP-glucose are described. Directed evolution of the GT encoded by SEQ ID NO: 3081 was carried out by constructing combinatorial libraries of variant genes. Libraries recombined mutations associated with improved activity in previous rounds and subjected certain structural features of the enzyme with saturation mutagenesis. These libraries were then plated, grown, and screened using the HTP assay described below, to provide an eleventh round ("Round 11") of engineered GT variant polypeptides with glucosyltransferase activity toward ADP-glucose and steviol glycosides. Fifty engineered variants were identified from the recombined beneficial mutations (Table 50.1), and 53 were identified from saturation mutagenesis (Table 50.2).

HTP Coupled Assay for Glucose Transfer from Sucrose to ADP to Rebaudioside A

Assays were performed on 96-well plates of cleared *E. coli* culture lysates expressing SEQ ID NO: 3081 variants. Lysis buffer volume was 400 µL, and the lysate was diluted 20-fold. For screening the library in which beneficial mutations from previous rounds were recombined, assays were conducted with 10 µL diluted lysate and 0.15 g/L SUS SFP SEQ ID NO: 1764 in 100 µL reaction volume with substrate loading of 8 mM rebaudioside A and co-substrate loadings of 0.2 mM ADP (Sigma, >95%) and 24 mM sucrose. The following reaction conditions were used: 50 mM potassium phosphate buffer, pH 6, 60° C. in a Thermotron® titre-plate shaker with 300 RPM shaking for 2 h. The reactions were diluted, quenched, and analyzed as described above. The resulting engineered variants with glucosyltransferase activity coupled with a SuS on rebaudioside A are listed in Table 50.1. For the round 11 saturation mutagenesis library, screening was performed as described above with the exception that a substrate loading of 10 mM rebaudioside A was used. The resulting engineered GT variant polypeptides are listed in Table 50.2. Shake-flask scale cultures were grown, lysed, and lyophilized to powder for several variants.

TABLE 50.1

β1,2GT Round 11 Combinatorial Variants and RebD Levels

| SEQ ID NO: (nt/aa) | Amino Acid Differences (Relative to SEQ ID NO: 3082) | Increased RebD[a] |
|---|---|---|
| 3181/3182 | V164H/G200A/D236T | +++ |
| 3183/3184 | G8S/I139V/G200A/D236T/N240E/D255P/ N423R | +++ |
| 3185/3186 | P107G/D236T/N240E/M325L/I440R | + |
| 3187/3188 | V164H/V322L/M325L/K416R/N423R | +++ |
| 3189/3190 | G8S/P107G/V164H/D255P | ++ |
| 3191/3192 | P107G/I139V/G200A/N240E/V322L/H324G/ M325L/K448A | + |
| 3193/3194 | G8S | ++ |
| 3195/3196 | V164H/P189R/D236T/N240E | ++ |
| 3197/3198 | V164H/D236T/N423R | + |
| 3199/3200 | V164H/D236T/N240E/I440R | + |
| 3201/3202 | G8S/P107G/I139V/V164H/G415A/K416R/ I440R/K448A | + |
| 3203/3204 | G8S/V164H/N240E/N423R | +++ |
| 3205/3206 | P107G/N423R | ++ |
| 3207/3208 | T12S/V164H/I440R | ++ |
| 3209/3210 | V164H/D236T | + |
| 3211/3212 | G8S/I139V/V164H/G200A/D236T/N240E/ V322L/I440R/K448A | ++ |
| 3213/3214 | V164H/P189R/N240E/G252D/G415A/N423R | + |
| 3215/3216 | V164H/G200A/D236T/D255P/V322L/H324G/ N423R/I440R | +++ |
| 3217/3218 | I139V | + |
| 3219/3220 | G8S/P107G/I139V/D255P/V322L/M325L/ G415A/K416R/I440R/K448A | +++ |
| 3221/3222 | V164H/P189R | + |

TABLE 50.1-continued

β1,2GT Round 11 Combinatorial Variants and RebD Levels

| SEQ ID NO: (nt/aa) | Amino Acid Differences (Relative to SEQ ID NO: 3082) | Increased RebD[a] |
|---|---|---|
| 3223/3224 | G8S/V164H/P189R/G200A/V322L/H324G/M325L/K416R/K448A | + |
| 3225/3226 | G8S/D236T/N240E/G252D/K448A | + |
| 3227/3228 | G8S/I139V/D255P/G415A/K416R | ++ |
| 3229/3230 | I139V/V164H/D236T/N240E | + |
| 3231/3232 | P107G/N240E/G252D/N423R/K448A | ++ |
| 3233/3234 | G8S/I139V/V164H/D236T/K416R/N423R/I440R | + |
| 3235/3236 | N240E/G252D/D255P/G415A/K448A | +++ |
| 3237/3238 | N240E/G252D/D255P/V322L/G415A/K416R | ++ |
| 3239/3240 | G8S/I139V | + |
| 3241/3242 | V164H/G200A/D236T/N240E/H324G/K416R/I440R | + |
| 3243/3244 | G8S/G252D/D255P/V322L/M325L/K448A | + |
| 3245/3246 | G200A/D236T/V322L/M325L/K416R | + |
| 3247/3248 | G200A/V322L/M325L/G415A/K448A | ++ |
| 3249/3250 | G415A/K416R/K448A | ++ |
| 3251/3252 | G8S/V164H/K448A | + |
| 3253/3254 | I139V/D255P/M325L/G415A/I440R | ++ |
| 3255/3256 | P107G/I139V | + |
| 3257/3258 | G8S/V164H/G252D/D255P/K448A | + |
| 3259/3260 | G8S/V164H | + |
| 3261/3262 | D236T/G415A/K416R | + |
| 3263/3264 | G8S/P107G/V164H/N423R/I440R | + |
| 3265/3266 | V164H/K416R/K448A | ++ |
| 3267/3268 | V164H/V322L/M325L | ++ |
| 3269/3270 | G8S/I139V/P189R/N240E/M325L/K416R | + |
| 3271/3272 | G8S/N240E/N423R | +++ |
| 3273/3274 | D255P/N423R | +++ |
| 3275/3276 | M325L | + |
| 3277/3278 | N240E | + |
| 3279/3280 | H2- | +++ |

[a]Levels of increased production were determined relative to the reference polypeptide of SEQ ID NO: 3082, and defined as follows:
"+" = production at least 1.25-fold, but less than 1.44-fold;
"++" = at least 1.44-fold, but less than 1.62-fold; and
"+++" = at least 1.62-fold increased production, as compared to the reference polypeptide.

TABLE 50.2

β1,2GT Round 11 Saturation Mutagenesis Variants and RebD Levels

| SEQ ID NO: (nt/aa) | Amino Acid Differences (Relative to SEQ ID NO: 3082) | Increased RebD[a] |
|---|---|---|
| 3385/3386 | H73T | + |
| 3387/3388 | N286L | + |
| 3389/3390 | F355A | ++ |
| 3391/3392 | P75H | + |
| 3393/3394 | D389F | ++ |
| 3395/3396 | E299L | ++ |
| 3397/3398 | H2T | + |
| 3399/3400 | L113I | +++ |
| 3401/3402 | H73A | +++ |
| 3403/3404 | K309R | ++ |
| 3405/3406 | P237M | + |
| 3407/3408 | R446H | + |
| 3409/3410 | H2N | ++ |
| 3411/3412 | P237V | ++ |
| 3413/3414 | T406N | +++ |
| 3415/3416 | H73P | + |
| 3417/3418 | E299R | + |
| 3419/3420 | E256I | + |
| 3421/3422 | D323P | + |
| 3423/3424 | P189S | + |
| 3425/3426 | T406F | + |
| 3427/3428 | H2S | + |
| 3429/3430 | T406Q | ++ |
| 3431/3432 | E299A | + |
| 3433/3434 | K34R | ++ |
| 3435/3436 | N286S | +++ |
| 3437/3438 | D305G | + |
| 3439/3440 | E313D | + |
| 3441/3442 | E256S | ++ |
| 3443/3444 | H73V | + |
| 3445/3446 | E256T | + |
| 3447/3448 | E186G | +++ |
| 3449/3450 | K422R | ++ |
| 3451/3452 | G8S | + |
| 3453/3454 | E186I | + |
| 3455/3456 | T406G | + |
| 3457/3458 | R446P | ++ |
| 3459/3460 | T239A | ++ |
| 3461/3462 | K422S | + |
| 3463/3464 | E299V | + |
| 3465/3466 | P237L | ++ |
| 3467/3468 | L312V | ++ |
| 3469/3470 | Q114V | +++ |
| 3471/3472 | H3I | + |
| 3473/3474 | E221K | + |
| 3475/3476 | L72Y | ++ |
| 3477/3478 | L312S | +++ |
| 3479/3480 | Q235M | +++ |
| 3481/3482 | E256L | +++ |
| 3483/3484 | D389G | + |
| 3485/3486 | K422C | + |
| 3487/3488 | L312T | +++ |
| 3489/3490 | E438T | +++ |

[a]Levels of increased production were determined relative to the reference polypeptide of SEQ ID NO: 3082, and defined as follows:
"+" = production at least 1.15-fold, but less than 1.2-fold;
"++" = at least 1.2-fold, but less than 1.27-fold; and
"+++" = at least 1.27-fold increased production, as compared to the reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 11 variants on rebaudioside A. Levels of 0.006-0.2 g/L shake flask powder (SFP) were added to a 100 μL total reaction volume containing 50 mM potassium phosphate buffer, pH 6, 10 mM rebaudioside A, 0.2 mM ADP, 24 mM sucrose, and 0.15 g/L SUS SFP SEQ ID NO: 1764. The reaction was performed at 60° C. in a Thermotron® titre-plate shaker at 300 RPM for 2 h. The reactions were diluted, quenched, and analyzed as described above. The round 11 variant that was most improved on rebaudioside A at 0.025 g/L SFP loading was SEQ ID NO: 3244, which had mutations G8S, G252D, D255P, V322L, M325L, and K448A relative to SEQ ID NO: 1764. This variant, SEQ ID NO: 3244, was used for further directed evolution.

HTP Coupled Assay for Glucose Transfer from Sucrose to ADP to Rebaudioside I

Directed evolution of the GT encoded by SEQ ID NO: 3081 was carried out by constructing libraries of variant genes in which mutations associated with improved glycosyltransferase activity toward rebaudioside I in previous rounds were recombined. These libraries were then plated, grown, and screened using the high-throughput (HTP) assay described below to provide a round ("Round 11.04") of engineered GT variant polypeptides with glucosyltransferase activity toward ADP-glucose and rebaudioside I. Cells were lysed with 400 μL lysis buffer. Assays were performed on 96-well plates of cleared E. coli culture lysates expressing SEQ ID NO: 3081 variants with lysate loading of 25 μL lysate in 100 μL reactions and with substrate loading of 1 mM rebaudioside I and co-substrate loading of 1 mM ADP-glucose. The following reaction conditions were used: 50 mM KPhos buffer, pH 6, 40° C. in a Thermotron® titre-plate shaker with 300 RPM shaking for 18 h. The reactions were diluted 1:4 in water and then quenched by adding 25 µL of the diluted assay to 75 µL acetonitrile with 0.2% formic acid. The resulting mixture was precipitated by centrifugation at 4° C. for 10 m. The supernatants were diluted 1:5 in water and analyzed by LC-MS/MS as described in Table 44.1. The resulting 52 engineered variants with glucosyltransferase activity on rebaudioside I are listed in Table 50.3.

TABLE 50.3

β1,2GT Round 11 Combinatorial Variants and RebM Levels

| SEQ ID NO: (nt/aa) | Amino Acid Differences (Relative to SEQ ID NO: 3082) | Increased RebM[a] |
|---|---|---|
| 3281/3282 | L126Q/P128A/F155R/R161G/N199A | + |
| 3283/3284 | W20Y/P128A/K160S/R161T/G198P | + |
| 3285/3286 | W20Y/L126Q/P128A/K160S/R161T/G198H | + |
| 3287/3288 | L126Q/P128A/K160S/N199A/P369N | + |
| 3289/3290 | P128A/K160S/R161G/P369N | + |
| 3291/3292 | P128A/F155R/K160S/G198P | + |
| 3293/3294 | L126H/P128A/K160S/G198H/P369N | + |
| 3295/3296 | P128A/G198H/N199A/P369N | + |
| 3297/3298 | N199A/P369N | ++ |
| 3299/3300 | L126Q/G198P/P369N | + |
| 3301/3302 | W20Y/L126H/K160S | + |
| 3303/3304 | L126Q/N199A/P369N | + |
| 3305/3306 | W20Y/F155R/R161T | + |
| 3307/3308 | W20Y/L126H/F155R/K160S/G198P | + |
| 3309/3310 | F155R/R161G/G198H/N199A | + |
| 3311/3312 | W20Y/L126H/P128A/R161T | + |
| 3313/3314 | L126H/K160S/G198P/P369N | + |
| 3315/3316 | L126Q/P128A/K160S/P369N | + |
| 3317/3318 | V121F/L126H/P128A/R161T/P369N | ++ |
| 3319/3320 | W20Y/P128A/F155R/N199A | + |
| 3321/3322 | P128A/F155R/K160S/R161T/N199A | + |
| 3323/3324 | W20Y/F155R/K160S/R161G | + |
| 3325/3326 | L126H/K160S/R161G/N199A/P369N | ++ |
| 3327/3328 | W20Y/L126Q/P128A/R161T/G198H/N199A | + |
| 3329/3330 | L126H/A196V/G198P/P369N | + |
| 3331/3332 | P128A/F155R/K160S/R161T | ++ |
| 3333/3334 | W20Y/P128A/F155R/K160S/R161T/G198H | + |
| 3335/3336 | W20Y/L126H/P128A/F155R/R161T | ++ |
| 3337/3338 | P128A/N199A/P369N | ++ |
| 3339/3340 | R161T/G198P/P369N | ++ |
| 3341/3342 | W20Y/L126H/K160S/R161T | ++ |
| 3343/3344 | L126H/P128A/R161G/P369N | ++ |
| 3345/3346 | L126Q/P128A/F155R/K160S/R161T/N199A | ++ |
| 3347/3348 | K160S/R161G/P369N | + |
| 3349/3350 | K160S/R161T/P369N | ++ |
| 3351/3352 | W20Y/P128A/F155R/R161T/N199A | ++ |
| 3353/3354 | L126H/P128A/F155R/K160S/R161T | + |
| 3355/3356 | W20Y/L126Q/R161G | + |
| 3357/3358 | F155R/N199A | ++ |
| 3359/3360 | W20Y/L126Q/P128A/K160S/R161T | +++ |
| 3361/3362 | L126H/P128A/R161G/N199A/P369N | +++ |
| 3363/3364 | P128A/F155R/N199A | +++ |
| 3365/3366 | R161T/P369N | +++ |
| 3367/3368 | L126Q/P128A/K160S/R161T/P369N | +++ |
| 3369/3370 | W20Y/L126Q/F155R/R161G | +++ |
| 3371/3372 | L126Q/P369N | +++ |
| 3373/3374 | W20Y/F155R/R161T/N199A | +++ |
| 3375/3376 | W20Y/K160S/R161T/G198H | +++ |
| 3377/3378 | W20Y/F155R/K160S | +++ |
| 3379/3380 | L126H/P128A/P369N | ++ |
| 3381/3382 | P128A/P369N | ++ |
| 3383/3384 | P128A/R161G/N199A/P369N | ++ |

[a]Levels of increased production were determined relative to the reference polypeptide of SEQ ID NO: 3082, and defined as follows:
"+" = production at least 3.24-fold, but less than 4.14-fold;
"++" = at least 4.14-fold, but less than 6-fold; and
"+++" = greater than 6-fold increased production, as compared to the reference polypeptide.

Shake Flask Powder Characterization Assay and Analysis for Glucosyl Transfer from Sucrose to ADP to Rebaudioside I A shake flask powder loading dose response experiment was performed to characterize activity of the engineered round 11.04 variants on rebaudioside I. Levels of 0.16-5 g/L shake flask powder (SFP) were added to a 100 µL total reaction volume containing 50 mM potassium phosphate buffer, pH 6, 1 mM rebaudioside 1, and 1 mM ADP-glucose. The reaction was performed at 50° C. in a Thermotron® titre-plate shaker at 300 RPM for 4 h. The reactions were diluted, quenched, and analyzed as described above. The production levels of rebaudioside M by the round 11.04 variants at 0.3 g/L SFP loading are shown in Table 50.4. All 5 of the variants listed in Table 50.4 had higher activities than SEQ ID NO: 3082 on RebI. The variant with the mutations L126Q, P128A, F155R, K160S, R161T, and N199A (SEQ ID NO: 3346) and its encoding polynucleotide (SEQ ID NO: 3345) were most improved and were selected for further directed evolution for the glucosylation of rebaudioside I

TABLE 50.4

β1,2GT Round 11 Shake Flask Variants and RebM Levels

| SEQ ID NO: (nt/aa) | Amino Acid Differences (Relative to SEQ ID NO: 3082) | Increased RebM[a] |
|---|---|---|
| 3295/3296 | P128A/G198H/N199A/P369N | + |
| 3345/3346 | L126Q/P128A/F155R/K160S/R161T/N199A | ++ |
| 3377/3378 | W20Y/F155R/K160S | ++ |
| 3381/3382 | P128A/P369N | ++ |
| 3379/3380 | L126H/P128A/P369N | ++ |

[a]Levels of increased production were determined relative to the reference polypeptide of SEQ ID NO: 3082, and defined as follows:
"+" = production at least 1.15-fold, but less than 1.8-fold; and
"++" = at least 1.8-fold increased production, as compared to the reference polypeptide.

Example 51

Beta-1,2-ADP-Glycosyltransferase Variants of SEQ ID NO: 3244

In this Example, experiments for evolution and screening of GT polypeptides derived from SEQ ID NO: 3244 for improved glucosylation of steviol glycosides using ADP-glucose are described. Directed evolution of the GT encoded by SEQ ID NO: 3243 was carried out by constructing combinatorial libraries of variant genes. Libraries recombined mutations associated with improved activity in previous rounds and subjected certain structural features of the enzyme with saturation mutagenesis. These libraries were then plated, grown, and screened using the HTP assay described below to provide a twelfth round ("Round 12") of engineered GT variant polypeptides with glucosyltransferase activity toward ADP-glucose and steviol glycosides. Fifty engineered variants were identified from the recombined beneficial mutations (Table 51.1), and 31 were identified from saturation mutagenesis (Table 51.2).

HTP Coupled Assay for Glucose Transfer from Sucrose to ADP to Rebaudioside A

Assays were performed on 96-well plates of cleared *E. coli* culture lysates expressing SEQ ID NO: 3243 variants. Lysis buffer volume was 400 µL, and the lysate was diluted 40-fold. For screening the library in which beneficial mutations from previous rounds were recombined, diluted lysates were preincubated at 62° C. for 0.5 h in an Eppendorf thermocycler. Assays were then conducted with 10 μL diluted lysate and 0.15 g/L SUS SFP SEQ ID NO: 1764 in 100 μL reaction volume with substrate loading of 15 mM rebaudioside A and co-substrate loadings of 0.2 mM ADP (Sigma, >95%) and 37.5 mM sucrose. The following reaction conditions were used: 50 mM potassium phosphate buffer, pH6, 60° C. in a Thermotron® titre-plate shaker with 300 RPM shaking for 4.5 h. The reactions were diluted, quenched, and analyzed as described above. The resulting engineered variants with glucosyltransferase activity coupled with SUS SEQ ID NO: 1764 on rebaudioside A are listed in Table 51.1. For the round 12 saturation mutagenesis library, screening was performed as described above, with the exception that the diluted lysates were preincubated at 65° C. for 0.5 h. The resulting engineered GT variant polypeptides are listed in Table 51.2. Shake-flask scale cultures were grown, lysed, and lyophilized to powder for variants listed in Table 51.3.

TABLE 51.1

β1,2GT Round 12 Combinatorial Variants and RebD Levels

| SEQ ID NO: (nt/aa) | Amino Acid Differences (Relative to SEQ ID NO: 3244) | Increased RebD$^a$ |
|---|---|---|
| 3491/3492 | K106A/N172R/G200A/E210V/N240E/A242I/E408P/G415A/K416R/N423R | ++ |
| 3493/3494 | N240E/A242I/G415A/N423R | ++ |
| 3495/3496 | N240E/A242I | +++ |
| 3497/3498 | V164H/N240E/A242I/G415R/N423R | + |
| 3499/3500 | G200A/N240E/A242I/G407S | ++ |
| 3501/3502 | K106A/V164H/G200A/E210V/G415A | +++ |
| 3503/3504 | N240E | +++ |
| 3505/3506 | V164H/G200A/E408P/G415A/K416R | ++ |
| 3507/3508 | T409L/G415R | + |
| 3509/3510 | G200A/E408P/T409L | ++ |
| 3511/3512 | E210V/N240E | +++ |
| 3513/3514 | V164H/N240E/A242I/E408P | + |
| 3515/3516 | K106A/V164H/G200A/N240E/E408P/T409L/K416R | ++ |
| 3517/3518 | G200A/A242I/G415A/K416R/N423R | + |
| 3519/3520 | K106A/V164H/E210V/N240E/E408P/T409L/K416R | + |
| 3521/3522 | N172R/N240E | + |
| 3523/3524 | N172R/N240E/A242I/G415R | + |
| 3525/3526 | K106A/N240E/A242I/T409L | + |
| 3527/3528 | K106A/V164H/E210V/E408P/T409L | + |
| 3529/3530 | K106A/E210V/N240E/E408P/G415R | ++ |
| 3531/3532 | K106A/N172R/G200A/E210V/A242I | +++ |
| 3533/3534 | N240E/E408P | +++ |
| 3535/3536 | N172R/G200A/E408P/K416R | + |
| 3537/3538 | K106A/N172R/E408P/T409L | ++ |
| 3539/3540 | V164H/N172R/N240E/A242I/G415R | ++ |
| 3541/3542 | V164H/N172R/A242I/E408P | + |
| 3543/3544 | N172R/G200A/N240E | + |
| 3545/3546 | N172R/G200A/E210V/N240E/E408P | + |
| 3547/3548 | K106A/N172R/T409L/N423R | ++ |
| 3549/3550 | N240E/A242I/E408P/K416R | + |
| 3551/3552 | K106A/N240E/A242I | ++ |
| 3553/3554 | N172R/E210V/G415A | ++ |
| 3555/3556 | V164H/N172R/G200A/E210V/A242I/T409L | + |
| 3557/3558 | K106A/A242I/E408P/T409L | +++ |
| 3559/3560 | K106A/N172R/N240E/A242I/T409L/G415R | ++ |
| 3561/3562 | N240E/G415R | ++ |
| 3563/3564 | K106A/V164H/N172R/A242I/T409L/K416R | + |
| 3565/3566 | G200A/E210V/N240E/A242I/T409L | + |
| 3567/3568 | V164H/N423R | ++ |
| 3569/3570 | K106A/V164H/G200A/E210V/A242I | +++ |
| 3571/3572 | K106A/V164H/N240E/G415A | ++ |
| 3573/3574 | K106A/G200A/E210V/T409L | +++ |
| 3575/3576 | K106A/V164H/T409L/G415A/N423R | + |
| 3577/3578 | K106A/V164H/N172R/G200A/T409L | + |
| 3579/3580 | N172R/N240E/T409L | + |
| 3581/3582 | K106A/N172R/A242I/K416R/N423R | + |
| 3583/3584 | K106A/E210V/N240E | + |

TABLE 51.1-continued

β1,2GT Round 12 Combinatorial Variants and RebD Levels

| SEQ ID NO: (nt/aa) | Amino Acid Differences (Relative to SEQ ID NO: 3244) | Increased RebD$^a$ |
|---|---|---|
| 3585/3586 | K106A/N172R/A242I | + |
| 3587/3588 | K106A/N172R/N240E | +++ |
| 3589/3590 | K106A/V164H/N172R/E210V/N240E/G415R | + |

$^a$Levels of increased production were determined relative to the reference polypeptide of SEQ ID NO: 3244, and defined as follows:
"+" = production at least 1.8-fold, but less than 1.9-fold;
"++" = at least 1.9-fold, but less than 2.07-fold; and
"+++" = at least 2.07-fold increased production, as compared to the reference polypeptide.

TABLE 51.2

β1,2GT Round 12 Saturation Mutagenesis Variants and RebD Levels

| SEQ ID NO: (nt/aa) | Amino Acid Differences (Relative to SEQ ID NO: 3244) | Increased RebD$^a$ |
|---|---|---|
| 3591/3592 | C46T | + |
| 3593/3594 | L49M | + |
| 3595/3596 | L49P | +++ |
| 3597/3598 | V134S | + |
| 3599/3600 | K143P | +++ |
| 3601/3602 | V134A | +++ |
| 3603/3604 | L49A | ++ |
| 3605/3606 | V278L | + |
| 3607/3608 | V179T | + |
| 3609/3610 | P232T | + |
| 3611/3612 | C46V | +++ |
| 3613/3614 | S105A | ++ |
| 3615/3616 | L49Q | ++ |
| 3617/3618 | L42I | + |
| 3619/3620 | V179D | ++ |
| 3621/3622 | I290L | ++ |
| 3623/3624 | Q35D | ++ |
| 3625/3626 | L42F | ++ |
| 3627/3628 | V134C | ++ |
| 3629/3630 | L49S | ++ |
| 3631/3632 | Q441R | + |
| 3633/3634 | L42V | + |
| 3635/3636 | A381G | + |
| 3637/3638 | L401V | + |
| 3639/3640 | V278I | + |
| 3641/3642 | R14K | + |
| 3643/3644 | K373R | + |
| 3645/3646 | Q441I | + |
| 3647/3648 | S336A | +++ |
| 3649/3650 | M181L | +++ |
| 3651/3652 | V179A | + |

$^a$Levels of increased production were determined relative to the reference polypeptide of SEQ ID NO: 3244, and defined as follows:
"+" = production at least that of the reference polypeptide, but less than 1.29-fold;
"++" = at least 1.29-fold, but less than 1.4-fold; and
"+++" = production at least 1.4-fold increased production, relative to the reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 12 variants on rebaudioside A. Levels of 0.006-0.2 g/L shake flask powder (SFP) were preincubated at 62° C. for 0.5 h and then added to a 100 μL total reaction volume containing 50 mM potassium phosphate buffer, pH 6, 15 mM rebaudioside A, 0.2 mM ADP, 37.5 mM sucrose, and 0.15 g/L SUS SFP SEQ ID NO: 1764. The reaction was performed at 50° C. and 60° C. in a Thermotron® titre-plate shaker at 300 RPM for 4.5 h. The reactions were diluted, quenched, and analyzed as described above. The conversion of the round 12 variants on rebaudioside A at 0.025 g/L SFP loading are listed in Table 51.3. All 7 of the variants listed in Table 51.3 had higher activities than SEQ ID NO: 3244 at 60° C., and 4 did not lose significant activity at 50° C. The variant with the mutations K106A, V164H, G200A, E210V, and G415A (SEQ ID NO: 3502) and its encoding polynucleotide (SEQ ID NO: 3501) were selected for further directed evolution for the glucosylation of rebaudioside A.

TABLE 51.3

β1,2GT Round 12 Shake Flask Variants and RebD Levels

| SEQ ID NO: (nt/aa) | Amino Acid Differences (Relative to SEQ ID NO: 3244) | Increased RebD, 60° C.[a] |
|---|---|---|
| 3501/3502 | K106A/V164H/G200A/E210V/G415A | +++ |
| 3515/3516 | K106A/V164H/G200A/N240E/E408P/ T409L/K416R | + |
| 3531/3532 | K106A/N172R/G200A/E210V/A242I | ++ |
| 3539/3540 | V164H/N172R/N240E/A242I/G415R | ++ |
| 3573/3574 | K106A/G200A/E210V/T409L | +++ |
| 3581/3582 | K106A/N172R/A242I/K416R/N423R | ++ |
| 3589/3590 | K106A/V164H/N172R/E210V/N240E/G415R | ++ |

[a]Levels of increased production were determined relative to the reference polypeptide of SEQ ID NO: 3244, and defined as follows:
"+" = production at least 1.24-fold, but less than 1.4-fold;
"++" = at least 1.4-fold, but less than 1.5-fold; and
"+++" = at least 1.5-fold increased production, relative to the reference polypeptide.

Example 52

Beta-1,2-ADP-Glycosyltransferase Variants of SEQ ID NO: 3346 for Rebaudioside M Production From Rebaudioside I In this Example, experiments for evolution and screening of GT polypeptides derived from SEQ ID NO: 3346 for improved glucosylation of steviol glycosides are described. Directed evolution of the GT encoded by SEQ ID NO: 3345 was carried out by constructing a library that subjected certain structural features of the enzyme to saturation mutagenesis. The library was then plated, grown, and screened using the high-throughput (HTP) assay described below to provide a round ("Round 12 RebI") of engineered GT variant polypeptides with glucosyltransferase activity toward ADP-glucose and rebaudioside I.

HTP Assay for Glucose Transfer from Sucrose to ADP to Rebaudioside M

Assays were performed on 96-well plates of cleared *E. coli* culture lysates expressing SEQ ID NO: 3345 variants. Lysis buffer volume was 400 μL, and assays were then conducted with 25 L lysate and 0.1 g/L SUS SFP SEQ ID NO: 1804 in 100 μL reaction volume with substrate loading of 1 mM rebaudioside I and co-substrate loadings of 1 mM ADP (Sigma, >95%) and 15 mM sucrose. The following reaction conditions were used: 50 mM potassium phosphate buffer, pH 6, 50° C. in a Thermotron® titre-plate shaker with 300 RPM shaking for 4 h. The reactions were diluted, quenched, and analyzed as described in Example 50. The resulting engineered variants with glucosyltransferase activity coupled with a SuS on rebaudioside I are shown in Table 52.1.

TABLE 52.1

β1,2GT Round 12 RebI Saturation Mutagenesis Variants and RebM Levels

| SEQ ID NO: (nt/aa) | Amino Acid Differences (Relative to SEQ ID NO: 3346) | Increased RebM[a] |
|---|---|---|
| 3759/3760 | G200T | + |
| 3761/3762 | F152L | + |
| 3763/3764 | P197D | + |
| 3765/3766 | P197Q | ++ |
| 3767/3768 | I202W | ++ |
| 3769/3770 | K143H | +++ |
| 3771/3772 | K187S | ++ |
| 3773/3774 | L195R | + |
| 3775/3776 | L195Y | ++ |
| 3777/3778 | G201W | ++ |
| 3779/3780 | Y268Q | + |
| 3781/3782 | P91M | + |
| 3783/3784 | G200P | ++ |
| 3785/3786 | P197W | + |
| 3787/3788 | L21M | + |
| 3789/3790 | G200E | ++ |
| 3791/3792 | F125C | +++ |
| 3793/3794 | Q127G | ++ |
| 3795/3796 | G201R | +++ |
| 3797/3798 | F264S | + |
| 3799/3800 | K143P/A150S | + |
| 3801/3802 | L21P | +++ |
| 3803/3804 | A130T/K187Q | +++ |
| 3805/3806 | I202A | + |
| 3807/3808 | E186V | + |
| 3809/3810 | G201A | ++ |
| 3811/3812 | L195S | + |
| 3813/3814 | F264T | + |
| 3815/3816 | G200R | +++ |
| 3817/3818 | F156Q | + |
| 3819/3820 | M364W | + |
| 3821/3822 | L195G | ++ |
| 3823/3824 | E186N | ++ |
| 3825/3826 | L145W | + |
| 3827/3828 | Q365L | +++ |
| 3829/3830 | G201S | ++ |
| 3831/3832 | Y268W | ++ |
| 3833/3834 | L195T | + |
| 3835/3836 | F125M | + |
| 3837/3838 | M364S | + |
| 3839/3840 | Y268F | ++ |
| 3841/3842 | G415D | + |
| 3843/3844 | F125V | + |
| 3845/3846 | L195F | +++ |
| 3847/3848 | F156P | ++ |
| 3849/3850 | P197L | + |

[a]Levels of increased production were determined relative to the reference polypeptide of SEQ ID NO: 3346, and defined as follows:
"+" = production at least 1.07-fold, but less than 1.19-fold;
"++" = at least 1.19-fold, but less than 1.33-fold; and
"+++" = at least 1.33-fold increased production, as compared to the reference polypeptide.

Example 53

Beta-1,2-ADP-Glycosyltransferase Variants of SEQ ID NO: 3502

In this Example, experiments for evolution and screening of GT polypeptides derived from SEQ ID NO: 3502 for improved glucosylation of steviol glycosides using ADP-glucose are described. Directed evolution of the GT encoded by SEQ ID NO: 3501 was carried out by constructing combinatorial libraries of variant genes. Libraries recombined mutations associated with improved activity in previous rounds and subjected certain structural features of the enzyme with saturation mutagenesis. These libraries were then plated, grown, and screened using the HTP assay described below to provide a thirteenth round ("Round 13") of engineered GT variant polypeptides with glucosyltransferase activity toward ADP-glucose and steviol glycosides. 53 engineered variants were identified from the recombined beneficial mutations (Table 53.1), and 24 were identified from saturation mutagenesis (Table 53.2).

HTP Coupled Assay for Glucose Transfer from Sucrose to ADP to Rebaudioside A

Assays were performed on 96-well plates of cleared *E. coli* culture lysates expressing SEQ ID NO: 3501 variants. Lysis buffer volume was 400 µL, and the lysate was diluted 40-fold. For screening the library in which beneficial mutations from previous rounds were recombined, diluted lysates were preincubated at 69° C. for 0.8 h in an Eppendorf thermocycler. Assays were then conducted with 10 µL diluted lysate and 0.15 g/L SUS SFP SEQ ID NO: 1764 in 100 µL reaction volume with substrate loading of 15 mM rebaudioside A and co-substrate loadings of 0.2 mM ADP (Sigma, >95%) and 37.5 mM sucrose. The following reaction conditions were used: 50 mM potassium phosphate buffer, pH 6, 60° C. in a Thermotron® titre-plate shaker with 300 RPM shaking for 4 h. The reactions were diluted, quenched, and analyzed as described above. The resulting engineered variants with glucosyltransferase activity coupled with SUS SEQ ID NO: 1764 on rebaudioside A are listed in Table 53.1. For the round 13 saturation mutagenesis library, screening was performed as described above with the exceptions that the diluted lysates were preincubated at 68° C. for 0.5 h, 0.1 g/L SUS SFP SEQ ID NO: 1804 was used, and either 0.1 or 0.2 mM ADP was used. The resulting engineered GT variant polypeptides are listed in Table 53.2. Shake-flask scale cultures were grown, lysed, and lyophilized to powder for the variants listed in Table 53.3.

TABLE 53.1

β1,2GT Round 13 Combinatorial Variants and RebD Levels

| SEQ ID NO: (nt/aa) | Amino Acid Differences (Relative to SEQ ID NO: 3502) | Increased RebD[a] |
|---|---|---|
| 3653/3654 | P237L | + |
| 3655/3656 | E186G/P237V/N286S | + |
| 3657/3658 | H2-/H5N/L113I/E186G/P237V/T406Q | +++ |
| 3659/3660 | H5N/E186G/P237V/K245T/E256I/T406Q | + |
| 3661/3662 | E186G/P237L | ++ |
| 3663/3664 | K34R/L113I/E186G/P237L/T406N | + |
| 3665/3666 | H5N/K34R/H73A/L113I/T406N | + |
| 3667/3668 | H5N/E186G/P237V/T406Q | ++ |
| 3669/3670 | H73A/P237V | + |
| 3671/3672 | H5N/L113I/P237V/T406N | + |
| 3673/3674 | E186G | ++ |
| 3675/3676 | H2-/H73A/E186G/P237V | + |
| 3677/3678 | H73A/E186G/P237L/T406Q | +++ |
| 3679/3680 | H5N/E256L/T406Q | ++ |
| 3681/3682 | L113I/E186G/T406Q | + |
| 3683/3684 | E186G/T406N | + |
| 3685/3686 | E186G/T406Q | + |
| 3687/3688 | H5N/H73A/E186G/T406N | ++ |
| 3689/3690 | P189S/N333H/F355A/S421Q | + |
| 3691/3692 | H2S/N286Q/F355A/K416R/K422R | ++ |
| 3693/3694 | H2S/P189S/N286Q | + |
| 3695/3696 | H73P/N172R/N240E/A242I/E408P | + |
| 3697/3698 | H73P/Q235M/N240E/E408P | + |
| 3699/3700 | H73P/N172R/Q235M/T239A/N240E | ++ |
| 3701/3702 | H73P/N172R/T239A/N240E | + |
| 3703/3704 | H73P/T239A/A242I | ++ |
| 3705/3706 | T239A/N240E | + |
| 3707/3708 | N172R/Q235M/N240E | + |
| 3709/3710 | L72Y/N172R/N240E/A242I | + |
| 3711/3712 | T239A/N240E/A242I/E256S/D323P | + |
| 3713/3714 | N240E/A242I/E256S/E438T | + |
| 3715/3716 | N172R/E188G/D323P | ++ |
| 3717/3718 | H73P/Q235M/N240E/D323P | ++ |
| 3719/3720 | A242I/E408P | + |
| 3721/3722 | T239A/N240E/E408P | +++ |
| 3723/3724 | H73P/N172R | + |
| 3725/3726 | H73P/N172R/T239A/N240E/A242I | +++ |
| 3727/3728 | T239A/A242I/E408P | + |
| 3729/3730 | L72Y/H73P/N172R/Q235M/N240E/A242I/E438T | ++ |
| 3731/3732 | Q235M/T239A/N240E | ++ |
| 3733/3734 | N172R | + |
| 3735/3736 | Q235M/N240E/A242I | +++ |
| 3737/3738 | N172R/T239A/N240E/A242I/D323P/E408P | ++ |
| 3739/3740 | H73P/N172R/Q235M/T239A/A242I | + |
| 3741/3742 | N172R/Q235M | ++ |
| 3743/3744 | T239A/N240E/A242I/D323P/E408P | ++ |
| 3745/3746 | H73P/N172R/N240E/E408P | +++ |
| 3747/3748 | L72Y/N172R/T239A/N240E/A242I/E408P | +++ |
| 3749/3750 | N172R/Q235M/T239A/E408P | + |
| 3751/3752 | N172R/N240E/E299A/D323P | ++ |
| 3753/3754 | N172R/Q235M/N240E/A242I/E438T | +++ |
| 3755/3756 | N172R/N240E | +++ |
| 3757/3758 | N172R/Q235M/T239A/N240E/A242I | +++ |

[a]Levels of increased production were determined relative to the reference polypeptide of SEQ ID NO: 3502, and defined as follows:
"+" = production at least 1.58-fold, but less than 1.79-fold;
"++" = at least 1.79-fold, but less than 2.07-fold; and
"+++" = at least 2.07-fold increased production, as compared to the reference polypeptide.

TABLE 53.2

β1,2GT Round 13 Saturation Mutagenesis Variants and RebD Levels

| SEQ ID NO: (nt/aa) | Amino Acid Differences (Relative to SEQ ID NO: 3502) | Increased RebD[a] |
|---|---|---|
| 3851/3852 | E186R | ++ |
| 3853/3854 | K187T | ++ |
| 3855/3856 | N199Y | + |
| 3857/3858 | Q132H | ++ |
| 3859/3860 | S153G | + |
| 3861/3862 | Q132T | + |
| 3863/3864 | A196S | + |
| 3865/3866 | S153A | + |
| 3867/3868 | Q127V | +++ |
| 3869/3870 | N199A | + |
| 3871/3872 | I144V | + |
| 3873/3874 | E186A | ++ |
| 3875/3876 | K187A | + |
| 3877/3878 | Q127L | + |
| 3879/3880 | Q132K | + |
| 3881/3882 | G96P | ++ |
| 3883/3884 | K187R | +++ |
| 3885/3886 | N199S | ++ |
| 3887/3888 | E186G | +++ |
| 3889/3890 | G96A | ++ |
| 3891/3892 | A200S | + |
| 3893/3894 | F156W | + |
| 3895/3896 | Q127I | +++ |
| 3897/3898 | F155M | +++ |

[a]Levels of increased production were determined relative to the reference polypeptide of SEQ ID NO: 3502, and defined as follows:
"+" = production at least that of the reference polypeptide, but less than 1.15-fold;
"++" = at least 1.15-fold, but less than 1.18-fold; and
"+++" = at least 1.18-fold increased production, as compared to the reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 13 variants on rebaudioside A. Levels of 0.006-0.2 g/L shake flask powder (SFP) were preincubated at 69° C. for 50 min and then added to a 100 µL total reaction volume containing 50 mM potassium phosphate buffer, pH6, 15 mM rebaudioside A, 0.2 mM ADP, 37.5 mM sucrose, and 0.1 g/L SUS SFP SEQ ID NO: 1804. The reaction was performed at 60° C. in a Thermotron® titre-plate shaker at 300 RPM for 4h. The reactions were diluted, quenched, and analyzed as described above. The conversion of the round 13 variants on rebaudioside A at 0.025 g/L SFP loading are listed in Table 53.3. All 10 of the variants listed in Table 53.3 had higher activities than SEQ ID NO: 3502. The variant with the mutations H73P, N172R, N240E, A242I, and E408P (SEQ ID NO: 3696) and its encoding polynucleotide (SEQ ID NO: 3695) were the most improved and were selected for further directed evolution for the glucosylation of rebaudioside A.

TABLE 53.3

β1,2GT Round 13 Shake Flask Variants and RebD Levels

| SEQ ID NO: (nt/aa) | Amino Acid Differences (Relative to SEQ ID NO: 3502) | Increased RebD[a] |
|---|---|---|
| 3695/3696 | H73P/N172R/N240E/A242I/E408P | +++ |
| 3689/3690 | P189S/N333H/F355A/S421Q | +++ |
| 3675/3676 | H2-/H73A/E186G/P237V | ++ |
| 3745/3746 | H73P/N172R/N240E/E408P | ++ |
| 3691/3692 | H2S/N286Q/F355A/K416R/K422R | ++ |
| 3657/3658 | H2-/H5N/L113I/E186G/P237V/T406Q | + |
| 3699/3700 | H73P/N172R/Q235M/T239A/N240E | + |
| 3703/3704 | H73P/T239A/A242I | + |
| 3693/3694 | H2S/P189S/N286Q | + |
| 3677/3678 | H73A/E186G/P237L/T406Q | + |

[a]Levels of increased production were determined relative to the reference polypeptide of SEQ ID NO: 3502 and defined as follows:
"+" = production at least 1.79-fold that of the reference polypeptide, but less than 3-fold;
"++" = at least 3-fold increased production but less than 3.6-fold; and
"+++" = at least 3.6-fold increased production relative to reference polypeptide.

Example 54

Beta-1,2-ADP-Glycosyltransferase Variants of SEQ ID NO: 3696

In this Example, experiments for evolution and screening of GT polypeptides derived from SEQ ID NO: 3696 for improved glucosylation of steviol glycosides using ADP-glucose are described. Directed evolution of the GT encoded by SEQ ID NO: 3695 was carried out by constructing combinatorial libraries of variant genes. Libraries recombined mutations associated with improved activity in previous rounds and subjected certain structural features of the enzyme with saturation mutagenesis. These libraries were then plated, grown, and screened using the HTP assay described below to provide a fourteenth round ("Round 14") of engineered GT variant polypeptides with glucosyltransferase activity toward ADP-glucose and steviol glycosides. Seventy-five engineered variants were identified from the recombined beneficial mutations (Table 54.1), and 49 were identified from saturation mutagenesis (Table 54.2).

HTP Coupled Assay for Glucose Transfer from Sucrose to ADP to Rebaudioside A

Assays were performed on 96-well plates of cleared *E. coli* culture lysates expressing SEQ ID NO: 3695 variants. Lysis buffer volume was 400 µL, and the lysate was diluted 40-fold. For screening the library in which beneficial mutations from previous rounds were recombined, diluted lysates were preincubated at 72 for 0.5 in an Eppendorf thermocycler. Assays were then conducted with 10 µL diluted lysate and 0.1 g/L sucrose synthetase (SUS) SFP SEQ ID NO:1804 in 100 µL reaction volume with substrate loading of 20 mM rebaudioside A and co-substrate loadings of 0.2 mM ADP (Sigma, >95%) and 50 mM sucrose. The following reaction conditions were used: 50M potassium phosphate buffer, pH6, 60° C. in a Thermotron® titre-plate shaker with 300 RPM shaking for 4h. The reactions were diluted, quenched, and analyzed as described above. The resulting engineered variants with glucosyltransferase activity coupled with a SuS on rebaudioside A are listed in Table 54.1. For the round 14 saturation mutagenesis library, screening was performed as described above with the exceptions that the lysate was diluted 80-fold and was preincubated at 70° C. for 0.5 h. The resulting engineered GT variant polypeptides are listed in Table 54.2. Shake-flask scale cultures were grown, lysed, and lyophilized to powder for variants listed in Table 54.3.

TABLE 54.1

β1,2GT Round 14 Combinatorial Variants and RebD Levels

| SEQ ID NO: (nt/aa) | Amino Acid Differences (Relative to SEQ ID NO: 3696) | Increased RebD[a] |
|---|---|---|
| 3899/3900 | I26V/L42V/C46V/V134A | + |
| 3901/3902 | L42V/C46V/L49P/V134C/Q235R/F355A/L401V | ++ |
| 3903/3904 | L42I/C46V/L49S/V134C/E186G | + |
| 3905/3906 | I26V/L49Q/V134A | + |
| 3907/3908 | C46V/L49Q/V134T | + |
| 3909/3910 | I26V/V134T/L401V | +++ |
| 3911/3912 | I26V/L42V/V134C/L401V | + |
| 3913/3914 | L42V/C46V/L49A/V134A/L401V | + |
| 3915/3916 | I26V/L42I/L49Q/V134C/E186G/F355A | +++ |
| 3917/3918 | I26V/L42I/L49Q/V134C/L401V | ++ |
| 3919/3920 | I26V/L42V/L49S/V134C | + |
| 3921/3922 | L42V/L49A/V134C/E186G/F355A | +++ |
| 3923/3924 | I26V/L42V/C46V/L49A/V134C/E186G | + |
| 3925/3926 | L42V/C46V/L49S/T97P/V134C/L401V | ++ |
| 3927/3928 | L42V/C46V/L49A/V134T/E186G/F355A | + |
| 3929/3930 | I26V/V134A/E186G/F355A/L401V | + |
| 3931/3932 | L42I/C46V/L49S/E186G | + |
| 3933/3934 | I26V/L42V/C46V/L49A | ++ |
| 3935/3936 | I26V/F355A/L401V | + |
| 3937/3938 | L42V/V134C/E186G | ++ |
| 3939/3940 | L42I/C46V/L49A/V134A | ++ |
| 3941/3942 | L42V/L49S/V134A/E186G/L401V | ++ |
| 3943/3944 | E186G/F355A | + |
| 3945/3946 | I26V/L42V | ++ |
| 3947/3948 | V134C/L401V | + |
| 3949/3950 | L42V/L49S/V134C/F355A/L401V | + |
| 3951/3952 | I26V/V134A | +++ |
| 3953/3954 | I26V/V134C/F355A | + |
| 3955/3956 | I26V/L42V/C46V/L49A/V134A | +++ |
| 3957/3958 | L49S/V134C/F355A | + |
| 3959/3960 | L42V/E186G/F355A | ++ |
| 3961/3962 | H2-/K143P/P232T/K373R/Q441R | + |
| 3963/3964 | H2-/K143P/K373R/Q441R | + |
| 3965/3966 | H5N/P237L/K373R/K422R | + |
| 3967/3968 | S105A/K373R/Q441R | + |
| 3969/3970 | H5N/K143P/P189S/P232T/P237V/Q441R | + |
| 3971/3972 | K143P/P232T | + |
| 3973/3974 | K143P/P189S/P232T/K422R/Q441R | + |
| 3975/3976 | H5N/K143P/P232T/K373R/K422R/Q441R | + |
| 3977/3978 | S105A/K143P/P232T/P237V/K373R/K416R/K422R/Q441R | + |
| 3979/3980 | K143P/P237V | + |
| 3981/3982 | H2-/H5N/Q35D/S105A/K143P/P237V/K373R/K416R/K422R | + |
| 3983/3984 | P189S/P232T/K373R/K416R/K422R/Q441R | ++ |
| 3985/3986 | S105A/P237L/K373R/K422R/Q441R | +++ |
| 3987/3988 | S105A/K373R | +++ |
| 3989/3990 | H5N/S105A/P237V/K416R/K422R/Q441R | + |
| 3991/3992 | H2-/H5N/Q35D/P232T/V278L/K373R/K416R | ++ |
| 3993/3994 | S105A/P189S/P237V | ++ |
| 3995/3996 | H2-/H5N/S105A/K143P/P232T/K373R/K416R/K422R | + |
| 3997/3998 | H2-/H5N/V278L | +++ |
| 3999/4000 | P232T/P237L | ++ |
| 4001/4002 | P237L/K422R | + |
| 4003/4004 | H5N/K143P/K373R | +++ |

TABLE 54.1-continued

β1,2GT Round 14 Combinatorial Variants and RebD Levels

| SEQ ID NO: (nt/aa) | Amino Acid Differences (Relative to SEQ ID NO: 3696) | Increased RebD[a] |
|---|---|---|
| 4005/4006 | K143P | +++ |
| 4007/4008 | Q35D/S105A/P189S/P232T/K373R/K416R | + |
| 4009/4010 | H2-/H5N/Q35D/K143P/P232T/P237L/K416R/K422R/Q441R | + |
| 4011/4012 | S105A/P237L/V278L/K373R/K416R/K422R | ++ |
| 4013/4014 | H5N/S105A/P232T/P237L/K373R/K416R/Q441R | ++ |
| 4015/4016 | H5N/K143P/P232T/P237L/K416R/K422R | +++ |
| 4017/4018 | S105A/K143P/V278L/K373R | ++ |
| 4019/4020 | K143P/P237L/K422R/Q441R | +++ |
| 4021/4022 | H5N/P232T/K416R/K422R | + |
| 4023/4024 | H5N/Q35D/P232T/K373R/K416R/K422R | ++ |
| 4025/4026 | P189S/P237L/V2781/K416R/Q441R | ++ |
| 4027/4028 | H5N/K143P/P237L/V278L/K373R/K416R/K422R | ++ |
| 4029/4030 | K143P/P189S/P237L/K373R/K416R/K422R | +++ |
| 4031/4032 | K143P/P1895 | +++ |
| 4033/4034 | H5N/S105A/P237L/V278I/K422R/Q441R | + |
| 4035/4036 | H5N/K373R/K416R | ++ |
| 4037/4038 | P237V/K373R/Q441R | ++ |
| 4039/4040 | Q35D | + |
| 4041/4042 | H2-/S105A/K143P/P232T/P237L/V278L/K373R/Q441R | ++ |
| 4043/4044 | H5N/P1895/P237V/V2781/K373R/K416R/K422R/Q441R | + |
| 4045/4046 | H5N/K143P/P232T/P237L/V278L | ++ |
| 4047/4048 | P237V/K373R | + |

[a]Levels of increased production were determined relative to the reference polypeptide of SEQ ID NO: 3696, and defined as follows:
"+" = production at least 1.5-fold, but less than 1.75-fold;
"++" = at least 1.75-fold, but less than 2-fold; and
"+++" = at least 2-fold increased production, as compared to the reference polypeptide.

TABLE 54.2

β1,2GT Round 14 Saturation Mutagenesis Variants and RebD Levels

| SEQ ID NO: (nt/aa) | Amino Acid Differences (Relative to SEQ ID NO: 3696) | Increased RebD[a] |
|---|---|---|
| 4049/4050 | A426L | + |
| 4051/4052 | S352A | ++ |
| 4053/4054 | T239F | + |
| 4055/4056 | R176Q | +++ |
| 4057/4058 | Q235R | +++ |
| 4059/4060 | F158W | + |
| 4061/4062 | H330C | ++ |
| 4063/4064 | T239Y | ++ |
| 4065/4066 | D243Y | +++ |
| 4067/4068 | T239P | ++ |
| 4069/4070 | H164E | +++ |
| 4071/4072 | D249H | + |
| 4073/4074 | D243R | + |
| 4075/4076 | H3N | + |
| 4077/4078 | R427S | + |
| 4079/4080 | H164F | + |
| 4081/4082 | I50P | + |
| 4083/4084 | S8R | + |
| 4085/4086 | T239G | + |
| 4087/4088 | T239M | ++ |
| 4089/4090 | S8V | ++ |
| 4091/4092 | D249G | ++ |
| 4093/4094 | D243G | ++ |
| 4095/4096 | P237A | + |
| 4097/4098 | D243H | ++ |
| 4099/4100 | D243S | ++ |
| 4101/4102 | H164L | + |
| 4103/4104 | P237L | + |
| 4105/4106 | D193F | + |
| 4107/4108 | R176P | +++ |
| 4109/4110 | 150V | +++ |
| 4111/4112 | R176T | + |

TABLE 54.2-continued

β1,2GT Round 14 Saturation Mutagenesis Variants and RebD Levels

| SEQ ID NO: (nt/aa) | Amino Acid Differences (Relative to SEQ ID NO: 3696) | Increased RebD[a] |
|---|---|---|
| 4113/4114 | H164A | + |
| 4115/4116 | A101L | ++ |
| 4117/4118 | I248T | + |
| 4119/4120 | T223A | ++ |
| 4121/4122 | T223L/D243G | + |
| 4123/4124 | Q137R | ++ |
| 4125/4126 | R427T | ++ |
| 4127/4128 | E61Y | + |
| 4129/4130 | E240V | +++ |
| 4131/4132 | E61N | +++ |
| 4133/4134 | M364Q | + |
| 4135/4136 | Q301A | ++ |
| 4137/4138 | K62A | ++ |
| 4139/4140 | R161L | + |
| 4141/4142 | D323T | + |
| 4143/4144 | D244N | +++ |
| 4145/4146 | T239Q | + |

[a]Levels of increased production were determined relative to the reference polypeptide of SEQ ID NO: 3696, and defined as follows:
"+" = production at least 1.1-fold, but less than 1.18-fold;
"++" = at least 1.18-fold, but less than 1.24-fold; and
"+++" = at least 1.24-fold increased production, as compared to the reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 14 variants on rebaudioside A. Levels of 0.006-0.2 g/L shake flask powder (SFP) were preincubated at 72° C. for 0.5 hand then added to a 100 μL total reaction volume containing 50 mM potassium phosphate buffer, pH 6, 20 mM rebaudioside A, 0.2 mM ADP, 50 mM sucrose, and 0.1 g/L SUS SFP SEQ ID NO: 1804. The reaction was performed at 60° C. with preincubated SFP or at 55° C. with SFP that had not undergone preincubation in a Thermotron® titre-plate shaker at 300 RPM for 4h. The reactions were diluted, quenched, and analyzed as described above. The production levels of rebaudioside D by the round 14 variants at 0.05 g/L SFP loading are shown in Table 54.3. Three out of the 8 variants listed in Table 54.3 had higher activities under both conditions than SEQ ID NO: 3696. The variant with the mutations I26V, L42V, C46V, L49A, and V134A (SEQ ID NO: 3956) and its encoding polynucleotide (SEQ ID NO: 3955) were the most improved taking into account both conditions and were selected for further directed evolution for the glucosylation of rebaudioside A.

TABLE 54.3

β1,2GT Round 14 Shake Flask Variants and RebD Levels

| SEQ ID NO: (nt/aa) | Amino Acid Differences (Relative to SEQ ID NO: 3696) | Increased RebD, 60° C.[a] |
|---|---|---|
| 3899/3900 | I26V/L42V/C46V/V134A | ++ |
| 3921/3922 | L42V/L49A/V134C/E186G/F355A | ++ |
| 3955/3956 | I26V/L42V/C46V/L49A/V134A | ++ |
| 3961/3962 | H2-/K143P/P232T/K373R/Q441R | + |
| 3969/3970 | H5N/K143P/P189S/P232T/P237V/Q441R | + |
| 3987/3988 | S105A/K373R | + |

TABLE 54.3-continued

β1,2GT Round 14 Shake Flask Variants and RebD Levels

| SEQ ID NO: (nt/aa) | Amino Acid Differences (Relative to SEQ ID NO: 3696) | Increased RebD, 60° C.[a] |
|---|---|---|
| 3997/3998 | H2-/H5N/V278L | + |
| 4041/4042 | H2-/S105A/K143P/P232T/P237L/V278L/ K373R/Q441R | + |

[a]Levels of increased production were determined relative to the reference polypeptide of SEQ ID NO: 3696, and defined as follows:
"+" = production at least 1.13-fold, but less than 1.4-fold; and
"++" = at least 1.4-fold increased production, as compared to the reference polypeptide.

Example 55

Beta-1,2-ADP-Glycosyltransferase Variants of SEQ ID NO: 3956

In this Example, experiments for evolution and screening of GT polypeptides derived from SEQ ID NO: 3956 for improved glucosylation of steviol glycosides using ADP-glucose are described. Directed evolution of the GT encoded by SEQ ID NO: 3955 was carried out by constructing combinatorial libraries of variant genes. Libraries recombined mutations associated with improved activity in previous rounds and subjected certain structural features of the enzyme with saturation mutagenesis. These libraries were then plated, grown, and screened using the HTP assay described below, to provide a fifteenth round ("Round 15") of engineered GT variant polypeptides with glucosyltransferase activity toward ADP-glucose and steviol glycosides. Sixty-two engineered variants were identified from the recombined beneficial mutations (Table 55.1), and 113 were identified from saturation mutagenesis (Table 55.2).

HTP Coupled Assay for Glucose Transfer from Sucrose to ADP to Rebaudioside A

Assays were performed on 96-well plates of cleared *E. coli* culture lysates expressing SEQ ID NO: 3956 variants. Lysis buffer volume was 400 µL, and the lysate was diluted 40-fold. For screening the library in which beneficial mutations from previous rounds were recombined, diluted lysates were preincubated at 76 for 0.5h in an Eppendorf thermocycler. Assays were then conducted with 10 µL diluted lysate and 0.1 g/L SUS SFP SEQ ID NO: 1840 in 100 µL reaction volume with substrate loading of 20 mM rebaudioside A and co-substrate loadings of 0.2 mM ADP (Sigma, >95%) and 50 mM sucrose. The following reaction conditions were used: 50 mM potassium phosphate buffer, pH6, 60° C. in a Thermotron® titre-plate shaker with 300 RPM shaking for 4h. The reactions were diluted, quenched, and analyzed as described above. The resulting engineered variants with glucosyltransferase activity coupled with SUS SEQ ID NO: 1840 on rebaudioside A are listed in Table 55.1. For the round 15 saturation mutagenesis library, screening was performed as described above with the exceptions that the diluted lysates were preincubated at 65° C. for 16 h and 0.1 g/L SUS SFP SEQ ID NO: 2064 was used. The resulting engineered GT variant polypeptides are listed in Table 55.2. Shake-flask scale cultures were grown, lysed, and lyophilized to powder for the variants listed in Table 55.3.

TABLE 55.1

β1,2GT Round 15 Combinatorial Variants and RebD Levels

| SEQ ID NO: (nt/aa) | Amino Acid Differences (Relative to SEQ ID NO: 3956) | Increased RebD[a] |
|---|---|---|
| 4147/4148 | A49S/S153A/F155M | ++ |
| 4149/4150 | S153A/N199S/T406Q | + |
| 4151/4152 | G96A/S153A/F155M/F156W | + |
| 4153/4154 | G96P/Q127I/S153A/F155M | + |
| 4155/4156 | A49S/G96P/Q132K/F155M/P237L/V278L | + |
| 4157/4158 | Q132H/F155M | + |
| 4159/4160 | A49S/G96P/F155M/N199S/A200S/T406Q | + |
| 4161/4162 | G96P/Q127I/Q132H/S153A/V278L | ++ |
| 4163/4164 | G96P/S153A/F155M/N199S/A200S/P237L | + |
| 4165/4166 | S153A/F155M/A196S/N199S/P237L | + |
| 4167/4168 | Q127I/Q132H/F155M/F156W/T406Q | + |
| 4169/4170 | G96A/Q132K/S153A/F155M/F156W | + |
| 4171/4172 | G96A/Q132K/S153A/F155M/F156W/A200S | + |
| 4173/4174 | G96P/S153A/T406Q | + |
| 4175/4176 | Q127I/T406Q | + |
| 4177/4178 | Q132K/P237L | + |
| 4179/4180 | A49S/G96A/Q127I/Q132K/F156W/A196S | +++ |
| 4181/4182 | A49S/G96P/Q127I/S153A/V278L | +++ |
| 4183/4184 | Q127I/S153A/F155M/N199S/A200S/P237L | ++ |
| 4185/4186 | Q127I/Q132H/S153A/F156W | +++ |
| 4187/4188 | S153A/P237L | ++ |
| 4189/4190 | Q132K/S153A/F155M | +++ |
| 4191/4192 | A49S/G96P/Q132H/F155M | ++ |
| 4193/4194 | S153A/F155M/F156W/P237L | +++ |
| 4195/4196 | G96A/Q132K/S153A/F156W | +++ |
| 4197/4198 | G96P/Q132H/S153A/F155M/F156W | ++ |
| 4199/4200 | A49S/G96A/Q132H/S153A/N199S/A200S | + |
| 4201/4202 | G96P/Q132K/V278L | +++ |
| 4203/4204 | Q127I/Q132H | + |
| 4205/4206 | G96P/Q132H/A196S/N199S | + |
| 4207/4208 | G96P/Q132K/S153A/F155M | ++ |
| 4209/4210 | Q132H/S153A/P237L/T406Q | ++ |
| 4211/4212 | F155M/N199S | ++ |
| 4213/4214 | A495/G96P/Q132H/S153A/F155M/F156W/ P237L/V278L/T406Q | ++ |
| 4215/4216 | H5N/P73A/I144V/K187R/K373R/K422R | ++ |
| 4217/4218 | H5N/I144V/V179T/M181L/K373R/K422R | ++ |
| 4219/4220 | V179T/M181L/E186A | + |
| 4221/4222 | K143P/V179T/M181L/E186G/K187R/K422R/ N423R | + |
| 4223/4224 | V179D/K187T/K373R/K422R | ++ |
| 4225/4226 | H5N/P73A/I144V/V179D/E186A/K373R/ N423R | +++ |
| 4227/4228 | I144V/V179T/M181L/E186A/K187R/K373R | +++ |
| 4229/4230 | V179D/M181L/E186G/K187R/N423R | ++ |
| 4231/4232 | P73A/L113I/V179T/M181L/E186A/K187R K373R/N423R | ++ |
| 4235/4236 | V179T/E186A/K187T | + |
| 4237/4238 | M181L/E186G/K187R/K422R/N423R | + |
| 4239/4240 | L113I/I144V/E186G/N423R | + |
| 4241/4242 | I144V/V179T/E186A/K187T/K373R | ++ |
| 4243/4244 | K143P/I144V/V179T/M181L/E186G/K187R/ K422R | + |
| 4245/4246 | L113I/K373R/K422R | + |
| 4247/4248 | P73A/L113I/K143P/V179T/M181L/K422R | ++ |
| 4249/4250 | L113I/I144V/K373R | ++ |
| 4251/4252 | P73A/M181L/E186A/K187T | +++ |
| 4253/4254 | H5N/K143P/I144V/V179T/M181L/E186G/ K187R/K373R | + |
| 4255/4256 | P73A/K143P/I144V/V179D/E186G/K187T/ K373R/N423R | +++ |
| 4257/4258 | H5N/I144V/K373R/K422R | +++ |
| 4259/4260 | L113I/K143P/V179D/E186G/K187R | + |
| 4261/4262 | P73A/V179D/M181L/E186G/K187R/K373R | ++ |
| 4263/4264 | L113I/M181L/E186A/K373R/K422R | + |
| 4265/4266 | H5N/P73A/K143P/I144V/V179D/E186G/ K187R/K422R | + |

TABLE 55.1-continued

β1,2GT Round 15 Combinatorial Variants and RebD Levels

| SEQ ID NO: (nt/aa) | Amino Acid Differences (Relative to SEQ ID NO: 3956) | Increased RebD[a] |
|---|---|---|
| 4267/4268 | P73A/V179D/M181L/E186A/K373R/K422R | ++ |
| 4269/4270 | H5N/P73A/L113I/E186G/K187R/K373R/N423R | + |

[a] Levels of increased production were determined relative to the reference polypeptide of SEQ ID NO: 3956, and defined as follows:
"+" = production at least 1.75-fold, but less than 2-fold;
"++" = at least 2-fold, but less than 2.38-fold; and
"+++" = at least 2.38-fold increased production, as compared to the reference polypeptide.

TABLE 55.2

β1,2GT Round 15 Saturation Mutagenesis Variants and RebD Levels

| SEQ ID NO: (nt/aa) | Amino Acid Differences (Relative to SEQ ID NO: 3956) | Increased RebD[a] |
|---|---|---|
| 4271/4272 | T12L | + |
| 4273/4274 | L222F | ++ |
| 4275/4276 | T220G | +++ |
| 4277/4278 | M238I | + |
| 4279/4280 | K117N | + |
| 4281/4282 | E388S | + |
| 4283/4284 | K57H | + |
| 4285/4286 | F41H | + |
| 4287/4288 | S66L | + |
| 4289/4290 | Y449L | +++ |
| 4291/4292 | P73S | ++ |
| 4293/4294 | L74M/M238V | + |
| 4295/4296 | D236L | ++ |
| 4297/4298 | H83R | + |
| 4299/4300 | N65R | + |
| 4301/4302 | P408T | ++ |
| 4303/4304 | E388A | + |
| 4305/4306 | K214T | + |
| 4307/4308 | M238G | +++ |
| 4309/4310 | Q132G | ++ |
| 4311/4312 | P82S | + |
| 4313/4314 | D387P | ++ |
| 4315/4316 | Y449H | ++ |
| 4317/4318 | M238A | ++ |
| 4319/4320 | K450V | ++ |
| 4321/4322 | K309T | +++ |
| 4323/4324 | K57G | ++ |
| 4325/4326 | D389G | ++ |
| 4327/4328 | K103Q | + |
| 4329/4330 | R391A | +++ |
| 4331/4332 | Y44H | + |
| 4333/4334 | K160Q | + |
| 4335/4336 | T406S | + |
| 4337/4338 | R391L | + |
| 4339/4340 | T406G | ++ |
| 4341/4342 | G138K | + |
| 4343/4344 | T220S | ++ |
| 4345/4346 | D236T | + |
| 4347/4348 | M238S | + |
| 4349/4350 | Y44S/K187T | ++ |
| 4351/4352 | N65Q | ++ |
| 4353/4354 | N286G | + |
| 4355/4356 | R391V | + |
| 4357/4358 | R418H | + |
| 4359/4360 | H85W | + |
| 4361/4362 | L135E | + |
| 4363/4364 | G138T | + |
| 4365/4366 | P140G | + |
| 4367/4368 | L45Y | +++ |
| 4369/4370 | Q11L | + |
| 4371/4372 | R418A | +++ |
| 4373/4374 | K214H | + |
| 4375/4376 | T223D | +++ |
| 4377/4378 | V70W | + |
| 4379/4380 | M238R | +++ |
| 4381/4382 | H393P | ++ |
| 4383/4384 | N65G | +++ |
| 4385/4386 | N65C | ++ |
| 4387/4388 | I55G | + |
| 4389/4390 | E299V | + |
| 4391/4392 | D236V | ++ |
| 4393/4394 | K103H | + |
| 4395/4396 | R182I | ++ |
| 4397/4398 | P408L | + |
| 4399/4400 | K57P | ++ |
| 4401/4402 | D389V | ++ |
| 4403/4404 | Q114I | ++ |
| 4405/4406 | K111F | + |
| 4407/4408 | Y449S | + |
| 4409/4410 | K309R | ++ |
| 4411/4412 | R182L | +++ |
| 4413/4414 | I55L | + |
| 4415/4416 | K160T | + |
| 4417/4418 | K117S | + |
| 4419/4420 | T12I | + |
| 4421/4422 | H393T | + |
| 4423/4424 | R418M | ++ |
| 4425/4426 | Y449R | + |
| 4427/4428 | K422L | ++ |
| 4429/4430 | K226Q | + |
| 4431/4432 | E430P | + |
| 4433/4434 | I55A | ++ |
| 4435/4436 | K56R | ++ |
| 4437/4438 | K450N | + |
| 4439/4440 | N65P | + |
| 4441/4442 | L113S | +++ |
| 4443/4444 | P162L | +++ |
| 4445/4446 | K160D | +++ |
| 4447/4448 | D387R | +++ |
| 4449/4450 | E256R | +++ |
| 4451/4452 | P73H | +++ |
| 4453/4454 | P167L | + |
| 4455/4456 | P140C | +++ |
| 4457/4458 | I412G | +++ |
| 4459/4460 | L159N | ++ |
| 4461/4462 | I412R | ++ |
| 4463/4464 | R391S | +++ |
| 4465/4466 | Q114G | + |
| 4467/4468 | M238T | ++ |
| 4469/4470 | L72V | +++ |
| 4471/4472 | G138S | ++ |
| 4473/4474 | Q11D | ++ |
| 4475/4476 | R182Y | + |
| 4477/4478 | D389A | + |
| 4479/4480 | K309S | + |
| 4481/4482 | E429D | ++ |
| 4483/4484 | R182Q | + |
| 4485/4486 | D387Q | + |
| 4487/4488 | K309P | ++ |
| 4489/4490 | D389L | + |
| 4491/4492 | R182V | + |
| 4493/4494 | Y449G | + |
| 4495/4496 | R182T | +++ |

[a] Levels of increased production were determined relative to the reference polypeptide of SEQ ID NO: 3956, and defined as follows:
"+" = production at least 1.15-fold, but less than 1.22-fold;
"++" = at least 1.22-fold, but less than 1.35-fold; and
"+++" = at least 1.35-fold increased production, as compared to the reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 15 variants on rebaudioside A. Levels of 0.006-0.2 g/L shake flask powder (SFP) were preincubated at 76° C. for 0.5 h and then added to a 100 μL total reaction volume containing 50 mM potassium phosphate buffer, pH6, 20 mM rebaudioside A, 0.2 mM ADP, 50 mM sucrose, and 0.1 g/L SUS SFP SEQ ID NO: 2064. The reaction was performed at 60° C. with preincubated SFP or at 55° C. without preincubation in a Thermotron® titre-plate shaker at 300 RPM for 4h. The reactions were diluted, quenched, and analyzed as described above. The production of rebaudioside D by the round 15 variants at 0.025 g/L SFP loading are listed in Table 55.3. Five out of the 9 variants listed in Table 55.3 had higher activities under both conditions than SEQ ID NO: 3956. The variant with the mutations P73A, K143P, I144V, V1791D, E186G, K187T, K373R, and N423R (SEQ ID NO: 4256) and its encoding polynucleotide (SEQ ID NO: 4255) were the most improved taking into account both conditions and were selected for further directed evolution for the glucosylation of rebaudioside A.

of engineered GT variant polypeptides with glucosyltransferase activity toward ADP-glucose and steviol glycosides. Twenty-seven engineered variants were identified from the recombined beneficial mutations (Table 56.1), and 66 were identified from saturation mutagenesis (Table 56.2).

HTP Coupled Assay for Glucose Transfer from Sucrose to ADP to Rebaudioside A

Assays were performed on 96-well plates of cleared *E. coli* culture lysates expressing SEQ ID NO: 4255 variants. Lysis buffer volume was 400 µL, and the lysate was diluted 40-fold. For screening the library in which beneficial mutations from previous rounds were recombined, diluted lysates were preincubated at 79° C. for 0.5 h in an Eppendorf thermocycler. Assays were then conducted with 10 µL diluted lysate and 0.05 g/L sucrose synthetase (SUS) SFP SEQ ID NO: 2064 in 100 µL reaction volume with substrate

TABLE 55.3

β1, 2GT Round 15 Shake Flask Variants and RebD Levels

| SEQ ID NO: (nt/aa) | Amino Acid Differences (Relative to SEQ ID NO: 3956) | Increased RebD, 60° C$^a$ |
|---|---|---|
| 4149/4150 | S153A/N199S/T406Q | ++ |
| 4151/4152 | G96A/S153A/F155M/F156W | + |
| 4193/4194 | S153A/F155M/F156W/P237L | + |
| 4217/4218 | H5N/I144V/V179T/M181L/K373R/K422R | ++ |
| 4225/4226 | H5N/P73A/I144V/V179D/E186A/K373R/N423R | +++ |
| 4251/4252 | P73A/M181L/E186A/K187T | + |
| 4255/4256 | P73A/K143P/I144V/V179D/E186G/K187T/K373R/N423R | +++ |
| 4267/4268 | P73A/V179D/M181L/E186A/K373R/K422R | + |

$^a$Levels of increased production were determined relative to the reference polypeptide of SEQ ID NO: 3956, and defined as follows: "+" = production at least 1.4-fold, but less than 1.75-fold; "++" = at least 1.75-fold, but less than 1.9-fold; and "+++" = at least 1.9-fold increased production, as compared to the reference polypeptide.

Example 56

Beta-1,2-ADP-Glycosyltransferase Variants of SEQ ID NO: 4256

In this Example, experiments for evolution and screening of GT polypeptides derived from SEQ ID NO: 4256 for improved glucosylation of steviol glycosides using ADP-glucose are described. Directed evolution of the GT encoded by SEQ ID NO: 4255 was carried out by constructing combinatorial libraries of variant genes. Libraries recombined mutations associated with improved activity in previous rounds and subjected certain structural features of the enzyme with saturation mutagenesis. These libraries were then plated, grown, and screened using the HTP assay described below to provide a sixteenth round ("Round 16")

loading of 20 mM rebaudioside A and co-substrate loadings of 0.2 mM ADP (Sigma, >95%) and 50 mM sucrose. The following reaction conditions were used: 50 mM potassium phosphate buffer, pH 6, 60° C. in a Thermotron® titre-plate shaker with 300 RPM shaking for 4h. The reactions were diluted, quenched, and analyzed as described above. The resulting engineered variants with glucosyltransferase activity coupled with SUS SEQ ID NO: 2064 on rebaudioside A are listed in Table 56.1. For the round 16 saturation mutagenesis library, screening was performed as described above with the exception that 0.05 g/L sucrose synthetase SFP SEQ ID NO: 2510 was used. The resulting engineered GT variant polypeptides are listed in Table 56.2. Shake-flask scale cultures were grown, lysed, and lyophilized to powder for variants listed in Table 56.3.

TABLE 56.1

β1, 2GT Round 16 Combinatorial Variants and RebD Levels

| SEQ ID NO: (nt/aa) | Amino Acid Differences (Relative to SEQ ID NO: 4256) | Increased RebD$^a$ |
|---|---|---|
| 4497/4498 | R427S | + |
| 4499/4500 | S153A/F155M/R427T | + |
| 4501/4502 | S153A | + |
| 4503/4504 | F155M/F156W | + |
| 4505/4506 | K62A/S153A/F155M/F156W/L159V | +++ |
| 4507/4508 | S153A/F156W/L159V | + |
| 4509/4510 | S153A/F155M/P237L/M238T/T239F/T406Q | +++ |
| 4511/4512 | S153A/F156W/N199S/P237L/R427T | ++ |
| 4513/4514 | S153A/L159V/P237L/M238G/S352A | ++ |
| 4515/4516 | F156W/N199S/R427T | +++ |
| 4517/4518 | F156W/N199S | + |
| 4519/4520 | S153A/F156W/R427T | +++ |
| 4521/4522 | F155M/F156W/R176Q/M181L/N199S | ++ |

TABLE 56.1-continued

β1, 2GT Round 16 Combinatorial Variants and RebD Levels

| SEQ ID NO: (nt/aa) | Amino Acid Differences (Relative to SEQ ID NO: 4256) | Increased RebD[a] |
|---|---|---|
| 4523/4524 | F155M/F156W/R176Q/M238T/R4275 | + |
| 4525/4526 | K62A/S153A/F155M/N199S/T406Q | ++ |
| 4527/4528 | S153A/R176Q/M181L/R4275 | ++ |
| 4529/4530 | S153A/F155M/M238T/T239F | + |
| 4531/4532 | F155M/M181L/N199S/M238G/T406Q | +++ |
| 4533/4534 | S153A/F155M/F156W/L159V/N199S/M238G/T406Q | + |
| 4535/4536 | K62A/S153A/F155M/F156W/L159V/R427T | + |
| 4537/4538 | S153A/F155M/F156W | ++ |
| 4539/4540 | H164E/I375L/N433D | + |
| 4541/4542 | I375L | ++ |
| 4543/4544 | I50V/Q137R/P189G/I375L | ++ |
| 4545/4546 | T223A/I375L | + |
| 4547/4548 | Q137R/H164E/I375L | + |
| 4549/4550 | S8V/I375L | + |

[a]Levels of increased production were determined relative to the reference polypeptide of SEQ ID NO: 4256, and defined as follows: "+" = production at least 1.75-fold, but less than 2.08-fold; "++" = at least 2.08-fold, but less than 2.33-fold; and "+++" = at least 2.33-fold increased production, as compared to the reference polypeptide.

TABLE 56.2

β1, 2GT Round 16 Saturation Mutagenesis Variants and RebD Levels

| SEQ ID NO: (nt/aa) | Amino Acid Differences (Relative to SEQ ID NO: 4256) | Increased RebD[a] |
|---|---|---|
| 4551/4552 | Y449K | +++ |
| 4553/4554 | A106S | + |
| 4555/4556 | N445R | ++ |
| 4557/4558 | E192L | +++ |
| 4559/4560 | F280W | ++ |
| 4561/4562 | S110G | + |
| 4563/4564 | L116I | + |
| 4565/4566 | N115A | + |
| 4567/4568 | A106K | + |
| 4569/4570 | Q132R | +++ |
| 4571/4572 | K416R | ++ |
| 4573/4574 | Y449Q | + |
| 4575/4576 | V385S | ++ |
| 4577/4578 | S9G | + |
| 4579/4580 | A106R | ++ |
| 4581/4582 | T220S | + |
| 4583/4584 | H99R | + |
| 4585/4586 | T220Q | ++ |
| 4587/4588 | N445K | ++ |
| 4589/4590 | N302P | + |
| 4591/4592 | G395Q | +++ |
| 4593/4594 | N65F | ++ |
| 4595/4596 | V385P | +++ |
| 4597/4598 | E192A | + |
| 4599/4600 | A200S | ++ |
| 4601/4602 | E131C | +++ |
| 4603/4604 | R423L | +++ |
| 4605/4606 | N447L | ++ |
| 4607/4608 | E136R | ++ |
| 4609/4610 | Y449R | ++ |
| 4611/4612 | N302S | + |
| 4613/4614 | E131S | ++ |
| 4615/4616 | N115T | + |
| 4617/4618 | P335R | + |
| 4619/4620 | E192P | + |
| 4621/4622 | Q399K | + |
| 4623/4624 | M238L | + |
| 4625/4626 | K245P | ++ |
| 4627/4628 | D190T | +++ |
| 4629/4630 | Q132T | + |
| 4631/4632 | T12S | + |
| 4633/4634 | I412R | +++ |
| 4635/4636 | E304I | + |
| 4637/4638 | R272H | + |
| 4639/4640 | M238I | + |
| 4641/4642 | A170E | +++ |
| 4643/4644 | P335K | ++ |
| 4645/4646 | T220M | +++ |
| 4647/4648 | H68I | + |
| 4649/4650 | E136S | + |
| 4651/4652 | G10D | ++ |
| 4653/4654 | N257H | +++ |
| 4655/4656 | Q178L | + |
| 4657/4658 | P194F | +++ |
| 4659/4660 | V385A | + |
| 4661/4662 | Y449L | + |
| 4663/4664 | V385C | + |
| 4665/4666 | E136G | + |
| 4667/4668 | I242L | ++ |
| 4669/4670 | P408E | + |
| 4671/4672 | E136D | + |
| 4673/4674 | G7H | + |
| 4675/4676 | N445H | + |
| 4677/4678 | K402R | + |
| 4679/4680 | E53N | ++ |
| 4681/4682 | Q132G | +++ |

[a]Levels of increased production were determined relative to the reference polypeptide of SEQ ID NO: 4256, and defined as follows: "+" = production at least 1.07-fold, but less than 1.27-fold; "++" = at least 1.27-fold, but less than 1.42 fold; and "+++" = at least 1.42-fold increased production, as compared to the reference polypeptide.

Shake Flask Powder Characterization Assay and Analysis for Glucosyl Transfer from Sucrose to ADP to Rebaudioside A A shake flask powder loading dose response experiment was performed to characterize activity of the engineered round 16 variants on rebaudioside A. Levels of 0.003-0.1 g/L shake flask powder (SFP) were preincubated at 79° C. for 0.5 h and then added to a 100 μL total reaction volume containing 50 mM potassium phosphate buffer, pH6, 20 mM rebaudioside A, 0.2 mM ADP, 50 mM sucrose, and 0.05 g/L SUS SFP SEQ ID NO: 2432. The reaction was performed at 60° C. in a Thermotron® titre-plate shaker at 300 RPM for 4 h. The reactions were diluted, quenched, and analyzed as described above. The production levels of rebaudioside D by the round 16 variants at 0.0125 g/L SFP loading are shown in Table 56.3. SEQ ID NO: 4550 was the most improved and was selected as the best enzyme for the catalysis of glycosyltransfer from ADP-glucose to rebaudioside A to form rebaudioside D.

TABLE 56.3

β1, 2GT Round 16 Shake Flask Variants and RebD Levels

| SEQ ID NO: (nt/aa) | Amino Acid Differences (Relative to SEQ ID NO: 4256) | Increased RebD[a] |
|---|---|---|
| 4549/4550 | S8V/I375L | +++ |
| 4539/4540 | H164E/I375L/N433D | +++ |
| 4497/4498 | R427S | ++ |
| 4545/4546 | T223A/I375L | ++ |
| 4515/4516 | F156W/N199S/R427T | + |
| 4531/4532 | F155M/M181L/N199S/M238G/T406Q | + |
| 4543/4544 | I50V/Q137R/P189G/I375L | + |
| 4501/4502 | S153A | + |

[a]Levels of increased production were determined relative to the reference polypeptide of SEQ ID NO: 4256, and defined as follows: "+" = production at least that of the reference polypeptide, but less than 1.3-fold; "++" = at least 1.3-fold, but less than 1.6-fold; and "+++" = at least 1.6-fold increased production, as compared to the reference polypeptide.

Example 57

Beta-1,2-ADP-Glycosyltransferase Variants of SEQ ID NO: 4550

In this Example, experiments for evolution and screening of GT polypeptides derived from SEQ ID NO: 4550 for improved glucosylation of steviol glycosides using ADP-glucose are described. Directed evolution of the GT encoded by SEQ ID NO: 4549 was carried out by constructing combinatorial libraries of variant genes. Libraries recombined mutations associated with improved production identified during the development of the present invention. These libraries were then plated, grown, and screened using the HTP assay described below to provide a seventeenth round ("Round 17") of engineered GT variant polypeptides with glucosyltransferase activity toward ADP-glucose and steviol glycosides. Seventy-three engineered variants were identified from the recombined beneficial mutations (Table 57.1).

HTP Coupled Assay for Glucose Transfer from Sucrose to ADP to Rebaudioside A60

Assays were performed on 96-well plates of cleared *E. coli* culture lysates expressing SEQ ID NO: 4549 variants. Lysis buffer volume was 400 µL, and the lysate was diluted 50 or 100-fold into 20 g/L rebaudioside A60% and pre-incubated for 2 h at 75'C. Assays were then conducted with 10 µL diluted lysate, 0.1 g/L SUS SFP SEQ ID NO: 2510, and 0.2 g/L β-1,3-glycosyltransferase (β1,3GT) SFP SEQ ID NO: 6864 in 100 µL reaction volume with substrate loading of 20 g/L rebaudioside A 60% (RebA60) and co-substrate loadings of 0.1 g/L ADP (Amresco, ultra pure grade) and 40 g/L sucrose. The following reaction conditions were used: 50 mM potassium phosphate buffer, pH6, 60° C. in a Thermotron® titre-plate shaker with 300 RPM shaking for 16-18 h. The reactions were solubilized by 40× dilution into water, quenched by 5× dilution into acetonitrile with 0.2% formic acid, precipitated by centrifugation, and diluted 10× into water for analysis as described above. The resulting engineered variants with glucosyltransferase activity coupled with a SuS on rebaudioside A are listed in Table 57.1. Shake-flask scale cultures were grown, lysed, and lyophilized to powder for variants listed in Table 57.2.

TABLE 57.1

β1, 2GT Round 17 Combinatorial Variants and RebM Levels

| SEQ ID NO: (nt/aa) | Amino Acid Differences (Relative to SEQ ID NO: 4550) | Increased RebM[a] |
|---|---|---|
| 7215/7216 | R427S | ++ |
| 7217/7218 | N65G/P143K/Q235R/R427S | + |
| 7219/7220 | N65G/Q1141/K422L/R427S | + |
| 7221/7222 | R427S/E429D | ++ |
| 7223/7224 | R418A/R427S | + |
| 7225/7226 | N65G/Q1141/R427S | ++ |
| 7227/7228 | N65G/P143K | + |
| 7229/7230 | Y44H/A73H/Q1271/L135E | ++ |
| 7231/7232 | Q11L/A73S/Q132K/L135E/P408A | + |
| 7233/7234 | Q11L/F41H/Q132K/V278L | +++ |
| 7235/7236 | Q11L/Q1271/Q132K/L135E/T406S | +++ |
| 7237/7238 | Q132K/L135E/R1821 | ++ |
| 7239/7240 | L45Y/T406G | ++ |
| 7241/7242 | R182L | + |
| 7243/7244 | L45Y/A73H/Q132K/L135E/R182L | +++ |
| 7245/7246 | L45Y/A73H/Q1271/Q132K/L135E/T406G/P408A | +++ |
| 7247/7248 | Q11L/F41H/Y44H/Q1271/Q132K/T406G | + |
| 7249/7250 | Q11L/R182L/T406S | + |
| 7251/7252 | L45Y/Q1271/Q132K/L135E/R182T/T406G/P408A | + |
| 7253/7254 | Q11L/A73H/Q1271/Q132K/T406G/P408A | +++ |
| 7255/7256 | A73H/Q1271 | ++ |
| 7257/7258 | Y44H/L45Y/Q1271/Q132K/L135E/G138T/R182L/T406S/P408A | + |
| 7259/7260 | Q11L/F41H/L45Y/A73H/Q1271/V278L/T406G/P408A | + |
| 7261/7262 | Q11L/Q1271/Q132K/L135E | +++ |
| 7263/7264 | Q11L/L45Y/Q1271/Q132K/L135E/G138T/R182T | ++ |
| 7265/7266 | Y44H/L45Y/Q127I/Q132K/V278L | +++ |
| 7267/7268 | Y44H/A73S/Q132K/L135E/T406G/P408A | ++ |
| 7269/7270 | Q132K/L135E/T406G | + |
| 7271/7272 | F41H/A73H/Q132K/L135E/T406G | + |
| 7273/7274 | Q11L/Y44H/A73S/Q1271/Q132K/L135E/T406G/P408A | + |
| 7275/7276 | Q11L/Y44H/Q1271 | + |
| 7277/7278 | Q11L/Y44H/Q132K/V278L/T406G | + |
| 7279/7280 | Q11L/Y44H/A73H/Q1271/Q132K/L135E | ++ |

TABLE 57.1-continued

β1, 2GT Round 17 Combinatorial Variants and RebM Levels

| SEQ ID NO: (nt/aa) | Amino Acid Differences (Relative to SEQ ID NO: 4550) | Increased RebM[a] |
|---|---|---|
| 7281/7282 | Q11L/Q127I/Q132K/R182T | + |
| 7283/7284 | Q11L/A73H/Q127I/Q132K/V278L/T406G/P408A | +++ |
| 7285/7286 | F41H/Y44H/L45Y/A73H/Q127I/Q132K/V278L | +++ |
| 7287/7288 | F41H/L45Y/Q127I/Q132K/L135E/V278L/T406S | +++ |
| 7289/7290 | L45Y/A73H/Q132K | +++ |
| 7291/7292 | Q11L/L45Y/T406G | ++ |
| 7293/7294 | Q11L/A73H/Q132K | ++ |
| 7295/7296 | L45Y/Q127I/Q132K | +++ |
| 7297/7298 | T406G | + |
| 7299/7300 | L45Y/Q132K/P408A | ++ |
| 7301/7302 | A73H/Q127I/Q132K | ++ |
| 7303/7304 | Y44H/L45Y/A73H/Q132K/L135E/T406G | ++ |
| 7305/7306 | Q11L/Q127I/Q132K/G138T/R182L | +++ |
| 7307/7308 | Q11L/A73S/Q127I/Q132K/L135E/R182L/V278L | +++ |
| 7309/7310 | Q11L/F41H/L45Y/Q127I/V278L/T406G | ++ |
| 7311/7312 | L45Y/Q127I/Q132K/L135E/R182L | ++ |
| 7313/7314 | Y44H/A73S/Q127I/L135E/R182L/V278L/T406G/P408A | + |
| 7315/7316 | Q127I | ++ |
| 7317/7318 | Q132K/L135E | ++ |
| 7319/7320 | L45Y/Q127I/L135E | ++ |
| 7321/7322 | Q127I/Q132K/L135E/R1821/T406G | + |
| 7323/7324 | Q132K/T406S | ++ |
| 7325/7326 | Q11L/L45Y/A73H/Q127I/L135E | + |
| 7327/7328 | Q11L/F41H/Y44H/Q127I/N278L/T406S | + |
| 7329/7330 | L45Y/A73S/V278L/T406G/P408A | ++ |
| 7331/7332 | Q127I/Q132K/L135E/R182L | + |
| 7333/7334 | Q11L/Y44H/L45Y/Q127I | + |
| 7335/7336 | Q11L/Q127I/Q132K/L135E/R182L | + |
| 7337/7338 | Q11L/Q132K/L135E/T406G/ | ++ |
| 7339/7340 | H164E/T220G/K309S/Y449H | + |
| 7341/7342 | H164E/T220G/Y449L | + |
| 7343/7344 | K309P/Y449L | + |
| 7345/7346 | K57G | + |
| 7347/7348 | H164E | + |
| 7349/7350 | Y449L | + |
| 7351/7352 | K309R | + |
| 7353/7354 | T220G/Y449H | + |
| 7355/7356 | K56R/K309P/Y449L | + |
| 7357/7358 | H164E/Y449H | + |
| 7359/7360 | K309T/Y449H | + |

[a]Levels of increased production were determined relative to the reference polypeptide of SEQ ID NO: 4550, and defined as follows: "+" = production at least 1.2-fold, but less than 1.52-fold; "++" = at least 1.52-fold, but less than 2.1-fold; and "+++" = at least 2.1-fold increased production, as compared to the reference polypeptide.

Shake Flask Powder Characterization Assay and Analysis for Glucosyl Transfer from Sucrose to ADP to Rebaudioside A60

A shake flask powder loading dose response experiment was performed to characterize activity of the engineered round 17 variants on rebaudioside A60%. Levels of 0.0003-0.04 g/L shake flask powder (SFP) were assayed in 100 μL total reaction volume containing 50 mM potassium phosphate buffer, pH6, 20 g/L RebA60, 0.1 g/L ADP, 40 g/L sucrose, 0.1 g/L SUS SFP SEQ ID NO: 2510, and 0.2 g/L β-1,3-glycosyltransferase (β1,3GT) SFP SEQ ID NO: 6864. The reaction was performed at 60° C. in a Thermotron® titre-plate shaker at 300 RPM for 16-18 h. The reactions were diluted, quenched, and analyzed as described above. The results for the production of rebaudioside M in the one-pot reaction by the round 17 variants at 0.005 g/L SFP loading are shown in Table 57.2. SEQ ID NO: 7324 was identified as being the most improved and was selected as the best enzyme for the catalysis of glycosyltransfer from ADP-glucose to rebaudioside A to form rebaudioside D.

TABLE 57.2

β1, 2GT Round 17 Shake Flask Variants and RebM Levels

| SEQ ID NO: (nt/aa) | Amino Acid Differences (Relative to SEQ ID NO: 4550) | Increased RebM[a] |
|---|---|---|
| 7215/7216 | R427S | − |
| 7225/7226 | N65G/Q114I/R427S | − |
| 7227/7228 | N65G/P143K | + |
| 7265/7266 | Y44H/L45Y/Q127I/Q132K/V278L | − |
| 7273/7274 | Q11L/Y44H/A73S/Q127I/Q132K/L135E/T406G/P408A | − |
| 7285/7286 | F41H/Y44H/L45Y/A73H/Q127I/Q132K/V278L | − |

TABLE 57.2-continued

β1, 2GT Round 17 Shake Flask Variants and RebM Levels

| SEQ ID NO: (nt/aa) | Amino Acid Differences (Relative to SEQ ID NO: 4550) | Increased RebM[a] |
|---|---|---|
| 7323/7324 | Q132K/T406S | ++ |
| 7343/7344 | K309P/Y449L | + |

[a]Levels of increased production were determined relative to the reference polypeptide of SEQ ID NO: 4550, and defined as follows: "−" = production less than that of the reference polypeptide; "+" = production at least that of the reference polypeptide, but less than 1.15-fold; and "++" = at least 1.15-fold increased production, as compared to the reference polypeptide.

Example 58

Beta-1,2-ADP-Glycosyltransferase Variants of SEQ ID NO: 7324

In this Example, experiments for evolution and screening of GT polypeptides derived from SEQ ID NO: 7324 for improved glucosylation of steviol glycosides using ADP-glucose are described. Directed evolution of the GT encoded by SEQ ID NO: 7323 was carried out by constructing combinatorial libraries of variant genes. Libraries recombined mutations associated with improved production identified during the development of the present invention and subjected certain structural features of the enzyme with saturation mutagenesis. These libraries were then plated, grown, and screened using the HTP assay described below to provide an eighteenth round ("Round 18") of engineered GT variant polypeptides with glucosyltransferase activity toward ADP-glucose and steviol glycosides. Ninety engineered variants were identified from the recombined beneficial mutations (Table 58.1), and 124 were identified from saturation mutagenesis (Table 58.2).

HTP Coupled Assay for Glucose Transfer from Sucrose to ADP to Rebaudioside A 60

Assays were performed on 96-well plates of cleared E. coli culture lysates expressing SEQ ID NO: 7323 variants. Lysis buffer volume was 400 μL, and the lysate was diluted 80-fold into 20 g/L rebaudioside A 60% and pre-incubated for 1.5 h at 75° C. Assays were then conducted with 10 μL diluted lysate, 0.05 g/L SUS SFP SEQ ID NO: 7506, and 0.1 g/L β-1,3-glycosyltransferase (β1,3GT) SFP SEQ ID NO: 7388, in 100 μL reaction volume with substrate loading of 20 g/L rebaudioside A 60% (RebA60) and co-substrate loadings of 0.05 g/L ADP (Amresco, ultra pure grade) and 40 g/L sucrose. The following reaction conditions were used: 50 mM potassium phosphate buffer, pH 6, 60° C. in a Thermotron® titre-plate shaker with 300 RPM shaking for 16-18 h. The reactions were solubilized by 40× dilution into water, quenched by 5× dilution into acetonitrile with 0.2% formic acid, precipitated by centrifugation, and diluted 10× into water for analysis as described above. The resulting engineered variants with glucosyltransferase activity coupled with a SuS on RebA60 are listed in Table 58.1. For the round 18 saturation mutagenesis library, screening was performed as described previously, with the exception that the lysate was diluted 100-fold into 50 mM Kphos pH6 and pre-incubated for 1 h at 75° C. The resulting engineered GT variant polypeptides are listed in Table 58.2. Shake-flask scale cultures were grown, lysed, and lyophilized to powder for variants listed in Table 58.3.

TABLE 58.1

β1, 2GT Round 18 Combinatorial Variants and RebM Levels

| SEQ ID NO: (nt/aa) | Amino Acid Differences (Relative to SEQ ID NO: 7324) | Increased RebM[a] |
|---|---|---|
| 7765/7766 | L1161/D190T/S406G/P408A | ++ |
| 7767/7768 | L1161/M238L/K245P | + |
| 7769/7770 | D190T/P194F/I412R | + |
| 7771/7772 | D190T/P194F/P335R/K416R | + |
| 7773/7774 | D190T/P194F | ++ |
| 7775/7776 | D190T/E192L/P194F | +++ |
| 7777/7778 | A170E/P194F/P335R/K416R | + |
| 7779/7780 | E192L/P194F | + |
| 7781/7782 | A170E/P335K/K416R | ++ |
| 7783/7784 | D190T/P194F/M238L/K245P | ++ |
| 7785/7786 | P194F | ++ |
| 7787/7788 | A170E/E192L/P194F/P335K | + |
| 7789/7790 | A170E/P194F | + |
| 7791/7792 | A170E/D190T/E192L/P194F | ++ |
| 7793/7794 | D190T | + |
| 7795/7796 | N115A/D190T/P194F | ++ |
| 7797/7798 | A170E/M238L | + |
| 7799/7800 | A170E/E192L | + |
| 7801/7802 | N115T/L1161/V278L | + |
| 7803/7804 | D190T/K245P/I412R | + |
| 7805/7806 | A170E/P335K | ++ |
| 7807/7808 | L1161/A170E/D190T | ++ |
| 7809/7810 | L1161/K416R | + |
| 7811/7812 | N115A/A170E/D190T/M238L/I412R | + |
| 7813/7814 | N115A/K245P/V278L | +++ |
| 7815/7816 | E192L/P194F/I242L/S406G/P408A | +++ |
| 7817/7818 | L1161/M238L | + |
| 7819/7820 | A170E/E192L/P194F/V278L | ++ |
| 7821/7822 | A170E | ++ |
| 7823/7824 | V278L | ++ |
| 7825/7826 | R272H/V385P | ++ |
| 7827/7828 | G10D/Q127I/K132R/V385P | + |
| 7829/7830 | G10D/A73H | + |
| 7831/7832 | G10D/E53N/R423L | ++ |
| 7833/7834 | E53N/K132G/E136R/N302P/R423L/R427S | + |
| 7835/7836 | G10D/K132R/N302P/V385P | +++ |
| 7837/7838 | G10D | + |
| 7839/7840 | K132G | + |
| 7841/7842 | A73H/V385S/R427S | +++ |
| 7843/7844 | A73H | +++ |
| 7845/7846 | V385S/R427S | + |
| 7847/7848 | N302P/V385S | + |
| 7849/7850 | G10D/E53N/R272H/R423L/R427S | + |
| 7851/7852 | Q127I | + |
| 7853/7854 | E53N/Q127I/K132R/V385S | ++ |
| 7855/7856 | N257H/V385S | ++ |
| 7857/7858 | N302P/V385P | +++ |
| 7859/7860 | E53N/A73H/A200S/R423L | ++ |
| 7861/7862 | A73H/K132R/E136R/V385S/R427S | ++ |
| 7863/7864 | V385S | +++ |
| 7865/7866 | G10D/A73H/Q127I | +++ |
| 7867/7868 | G7V/G10D/A73H/Q127I/K132G/V385P/R423L | ++ |
| 7869/7870 | R423L/R427S | +++ |
| 7871/7872 | A200S | +++ |
| 7873/7874 | A73H/V385S | +++ |
| 7875/7876 | E53N/Q127I/E136R/V385L | +++ |
| 7877/7878 | R272H/N302P | +++ |
| 7879/7880 | E53N/K132G/N302P/V385S/R423L/R427S | +++ |
| 7881/7882 | A200S/V385S | +++ |

TABLE 58.1-continued

β1, 2GT Round 18 Combinatorial Variants and RebM Levels

| SEQ ID NO: (nt/aa) | Amino Acid Differences (Relative to SEQ ID NO: 7324) | Increased RebM[a] |
|---|---|---|
| 7883/7884 | G10D/E53N/A73H/H99R | ++ |
| 7885/7886 | A73H/Q1271/R427S | +++ |
| 7887/7888 | T220M/N445K | + |
| 7889/7890 | N65G/T220Q/N445R/Y449K | + |
| 7891/7892 | Y449L | + |
| 7893/7894 | Q399K/S406G | + |
| 7895/7896 | Q399K/S 406G/Y449L | +++ |
| 7897/7898 | P143K/K309P/N445K/N447L/Y449L | + |
| 7899/7900 | N65G/K402R/S 406G/N445R/Y449R | ++ |
| 7901/7902 | P143K/K309P/K402R | + |
| 7903/7904 | N65G/Q399K/S 406G/N447L/Y449R | + |
| 7905/7906 | T220Q/N445K/N447L | + |
| 7907/7908 | N445K/Y449L | + |
| 7909/7910 | K309P/Q399K/Y449L | ++ |
| 7911/7912 | N445R/Y449L | + |
| 7913/7914 | S406G/N445R/Y449K | + |
| 7915/7916 | N445R/N447L/Y449L | ++ |
| 7917/7918 | N65G/N445K/N447L/Y449R | ++ |
| 7919/7920 | S406G/N445R/N447L/Y449L | ++ |
| 7921/7922 | S406G/N445K/Y449R | +++ |
| 7923/7924 | N65G/A106R/N445K/N447L/Y449L | ++ |
| 7925/7926 | P143K/T220Q/N445K/N447L | + |
| 7927/7928 | K402R/N445R/Y449L | + |
| 7929/7930 | N65G/T220Q/K309P/N445R/N447L | + |
| 7931/7932 | A106R/T220Q/Q399K/K402R/S406G | + |
| 7933/7934 | N65G/N447L/Y449L | ++ |
| 7935/7936 | N447L | ++ |
| 7937/7938 | K309P/N445K/N447L/Y449L | + |
| 7939/7940 | N65G/T220Q/N445R/Y449R | + |
| 7941/7942 | T220Q/Q399K | + |
| 7943/7944 | N65G/P143K/T220Q | + |

[a]Levels of increased production were determined relative to the reference polypeptide of SEQ ID NO: 7324, and defined as follows: "+" = production at least that of the reference polypeptide, but less than 1.16-fold; "++" = at least 1.16-fold, but less than 1.23-fold; and "+++" = at least 1.23-fold increased production, as compared to the reference polypeptide.

TABLE 58.2

β1, 2GT Round 18 Saturation Mutagenesis Variants and RebM Levels

| SEQ ID NO: (nt/aa) | Amino Acid Differences (Relative to SEQ ID NO: 7324) | Increased RebM[a] |
|---|---|---|
| 8091/8092 | N51Q | + |
| 8093/8094 | A434C | + |
| 8095/8096 | S64R | ++ |
| 8097/8098 | V46Q | + |
| 8099/8100 | V46L | ++ |
| 8101/8102 | Q11L/Y44H | +++ |
| 8103/8104 | V46C | + |
| 8105/8106 | V46T | ++ |
| 8107/8108 | A49K | ++ |
| 8109/8110 | D119T/R172H | ++ |
| 8111/8112 | V376N | + |
| 8113/8114 | G41OR | + |
| 8115/8116 | A130S | + |
| 8117/8118 | A49N/S406G/P408A | + |
| 8119/8120 | A398R | +++ |
| 8121/8122 | G356T | ++ |
| 8123/8124 | I420F | ++ |
| 8125/8126 | D274Q | + |
| 8127/8128 | Q11L/E71P | +++ |
| 8129/8130 | A381C | ++ |
| 8131/8132 | P118S | ++ |
| 8133/8134 | D274T | +++ |
| 8135/8136 | S64G | +++ |
| 8137/8138 | A398H | ++ |
| 8139/8140 | V133H | ++ |
| 8141/8142 | D119G | ++ |
| 8143/8144 | P118A | ++ |
| 8145/8146 | A49G | ++ |
| 8147/8148 | K100R | + |
| 8149/8150 | G338S | + |
| 8151/8152 | N157E | + |
| 8153/8154 | V259T | + |
| 8155/8156 | P118L | ++ |
| 8157/8158 | A141Q | ++ |
| 8159/8160 | D1791 | ++ |
| 8161/8162 | I43T | +++ |
| 8163/8164 | S406G/P408A | +++ |
| 8165/8166 | P169E | +++ |
| 8167/8168 | Q441L | ++ |
| 8169/8170 | Q11L/V287S | +++ |
| 8171/8172 | N108G/R172H | +++ |
| 8173/8174 | V376S | +++ |
| 8175/8176 | G356S | + |
| 8177/8178 | E71T | +++ |
| 8179/8180 | 1397L/S406G/P408A | ++ |
| 8181/8182 | I420L | + |
| 8183/8184 | Q11L/E71T | + |
| 8185/8186 | N51M | + |
| 8187/8188 | D119S | + |
| 8189/8190 | A398K | + |
| 8191/8192 | N333S/S406G/P408A | + |
| 8193/8194 | V287L | + |
| 8195/8196 | A398L | + |
| 8197/8198 | E437G | + |
| 8199/8200 | R172H/I420L | +++ |
| 8201/8202 | R172H/E437D | + |
| 8203/8204 | V42A | +++ |
| 8205/8206 | V287A | ++ |
| 8207/8208 | A141G | +++ |
| 8209/8210 | S47N | +++ |
| 8211/8212 | P118A/S406G/P408A | + |
| 8213/8214 | Q11L/Q441S | + |
| 8215/8216 | P118V | +++ |
| 8217/8218 | S64L | +++ |
| 8219/8220 | V417C | +++ |
| 8221/8222 | M275L | +++ |
| 8223/8224 | V376G | +++ |
| 8225/8226 | E437V | +++ |
| 8227/8228 | E396A | +++ |
| 8229/8230 | E76H | +++ |
| 8231/8232 | V133R | ++ |
| 8233/8234 | T97V | + |
| 8235/8236 | H2T | ++ |
| 8237/8238 | I112T | + |
| 8239/8240 | I112N | + |
| 8241/8242 | N157T | + |
| 8243/8244 | F109V | ++ |
| 8245/8246 | S64A | + |
| 8247/8248 | F109L | + |
| 8249/8250 | L401T | + |
| 8251/8252 | V133S | + |
| 8253/8254 | V287S | + |
| 8255/8256 | D119A | + |
| 8257/8258 | V287K | + |
| 8259/8260 | P1181 | + |
| 8261/8262 | I43L | + |
| 8263/8264 | R394H/I420W | + |
| 8265/8266 | N108T | + |
| 8267/8268 | V376R | + |
| 8269/8270 | N288P | + |
| 8271/8272 | T48S/A398V | + |
| 8273/8274 | V385A | + |
| 8275/8276 | I112Q | + |
| 8277/8278 | M181H | ++ |
| 8279/8280 | V133L | + |
| 8281/8282 | A134S | ++ |
| 8283/8284 | N157C | + |
| 8285/8286 | N51V | + |
| 8287/8288 | N333S/A398T | + |
| 8289/8290 | M181T | + |
| 8291/8292 | T97L | ++ |

TABLE 58.2-continued

β1, 2GT Round 18 Saturation Mutagenesis Variants and RebM Levels

| SEQ ID NO: (nt/aa) | Amino Acid Differences (Relative to SEQ ID NO: 7324) | Increased RebM[a] |
|---|---|---|
| 8293/8294 | E396S | ++ |
| 8295/8296 | H4F | + |
| 8297/8298 | A141S | ++ |
| 8299/8300 | I112V | +++ |
| 8301/8302 | V42D/G138C | ++ |
| 8303/8304 | S64V | + |
| 8305/8306 | E76L | + |
| 8307/8308 | K117R/N157T/Q301R | + |
| 8309/8310 | V376M | + |
| 8311/8312 | S64Q | + |
| 8313/8314 | V417S | ++ |
| 8315/8316 | V42A/A141P | ++ |
| 8317/8318 | A398M | + |
| 8319/8320 | A37G | + |
| 8321/8322 | I112R | ++ |
| 8323/8324 | I43M | ++ |
| 8325/8326 | F109Y | ++ |
| 8327/8328 | V357T | + |
| 8329/8330 | D179R | ++ |
| 8331/8332 | I43A | + |
| 8333/8334 | G40Q | + |
| 8335/8336 | V42G | +++ |
| 8337/8338 | S64F | +++ | aLevels of increased production were determined relative to the reference polypeptide of SEQ ID NO: 7324, and defined as follows: "+" = production at least 1.1-fold, but less than 1.22-fold; "++" = at least 1.22-fold, but less than 1.3-fold; and "+++" = at least 1.3-fold increased production, as compared to the reference polypeptide.

Shake Flask Powder Characterization Assay and Analysis for Glucosyl Transfer from Sucrose to ADP to Rebaudioside A 60

A shake flask powder loading dose response experiment was performed to characterize activity of the engineered round 18 variants on rebaudioside A60%. Levels of 0.0013-0.04 g/L shake flask powder (SFP) were assayed in 100 μL total reaction volume containing 50 mM potassium phosphate buffer, pH6, 20 g/L RebA60, 0.05 g/L ADP, 40 g/L sucrose, 0.05 g/L SUS SFP SEQ ID NO: 7506, and 0.15 g/L β-1,3-glycosyltranferase (β1,3GT) SFP SEQ ID NO:7388. The reaction was performed at 60° C. in a Thermotron® titre-plate shaker at 300 RPM for 16-18 h. The reactions were diluted, quenched, and analyzed as described above. The production levels of rebaudioside M in the one-pot reaction by the round 18 variants at 0.005 g/L SFP loading are shown in Table 58.3. The variant with SEQ ID NO: 7784 was the most improved variant. Thus, it was selected as the best enzyme for the catalysis of glycosyltransfer from ADP-glucose to rebaudioside A to form rebaudioside D.

TABLE 58.3

β1, 2GT Round 18 Shake Flask Variants and RebM Levels

| SEQ ID NO: (nt/aa) | Amino Acid Differences (Relative to SEQ ID NO: 7324) | Increased RebM[a] |
|---|---|---|
| 7783/7784 | D190T/P194F/M238L/K245P | ++ |
| 7795/7796 | N115A/D190T/P194F | ++ |
| 7805/7806 | A170E/P335K | − |
| 7813/7814 | N115A/K245P/V278L | + |
| 7841/7842 | A73H/V385S/R427S | − |
| 7869/7870 | R423L/R427S | − |
| 7885/7886 | A73H/Q1271/R427S | − |
| 7895/7896 | Q399K/S406G/Y449L | + |
| 7903/7904 | N65G/Q399K/S406G/N447L/Y449R | ++ |
| 7933/7934 | N65G/N447L/Y449L | + | aLevels of increased production were determined relative to the reference polypeptide of SEQ ID NO: 7324, and defined as follows: "−" = production less than that of the reference polypeptide; "+" = production at least that of the reference polypeptide, but less than 1.08-fold; and "++" = at least 1.08-fold increased production, as compared to the reference polypeptide.

Example 59

Beta-1,2-ADP-Glycosyltransferase Variants of SEQ ID NO: 7784

In this Example, experiments for evolution and screening of GT polypeptides derived from SEQ ID NO: 7784 for improved glucosylation of steviol glycosides using ADP-glucose are described. Directed evolution of the GT encoded by SEQ ID NO: 7783 was carried out by constructing libraries of variant genes. Libraries recombined mutations associated with improved production identified during the development of the present invention and subjected certain structural features of the enzyme with saturation mutagenesis. These libraries were then plated, grown, and screened using the HTP assay described below to provide an nineteenth round ("Round 19") of engineered GT variant polypeptides with glucosyltransferase activity toward ADP-glucose and steviol glycosides. Eighty-seven engineered variants were identified from the combinatorial libraries (Table 59.1), and fifty-eight were identified from the saturation mutagenesis libraries (Table 59.2).

HTP Coupled Assay for Glucose Transfer from Sucrose to ADP to Rebaudioside A 60

Assays were performed on 96-well plates of cleared *E. coli* culture lysates expressing SEQ ID NO: 7783 variants. Lysis buffer volume was 400 μL, and the lysate was diluted 100-fold into 50 mM potassium phosphate, pH 6.0, and pre-incubated for 1 h at 75° C. Assays were then conducted with 10 L diluted lysate, 0.04 g/L SUS SFP SEQ ID NO: 8420, and 0.1 g/L β-1,3-glycosyltransferase (β1,3GT) SFP SEQ ID NO: 8088, in 100 μL reaction volume with substrate loading of 20 g/L rebaudioside A 60% (RebA60) and co-substrate loadings of 0.025 g/L ADP (Amresco, ultra pure grade) and 40 g/L sucrose. The following reaction conditions were used: 50 mM potassium phosphate buffer, pH 6, 60° C. in a Thermotron® titre-plate shaker with 300 RPM shaking for 16-18 h. The reactions were solubilized by 20× dilution into water, quenched by 5× dilution into acetonitrile with 0.2% formic acid, precipitated by centrifugation, and diluted 20× into water for analysis as described above. The resulting engineered variants with glucosyltransferase activity coupled with a SuS on RebA60 are listed in Table 59.1 and 59.2. Shake-flask scale cultures were grown, lysed, and lyophilized to powder for variants listed in Table 59.3.

TABLE 59.1

β1, 2GT Round 19 Combinatorial Variants and RebM Levels

| SEQ ID NO: (nt/aa) | Amino Acid Differences (Relative to SEQ ID NO: 7784) | Increased RebMa |
|---|---|---|
| 8623/8624 | S64R | + |
| 8625/8626 | I112T | +++ |
| 8627/8628 | Q11L/S64R/F109V | ++ |
| 8629/8630 | S64R/N65G/F109V | + |
| 8631/8632 | Q11L | ++ |
| 8633/8634 | S64R/N65G/I112T | ++ |
| 8635/8636 | S64R/N65G/I112N | ++ |
| 8637/8638 | F109V/I112T | + |
| 8639/8640 | F109V/S406G | + |
| 8641/8642 | F109L/I112T | + |
| 8643/8644 | F109V | ++ |
| 8645/8646 | F109V/A134S | + |
| 8647/8648 | I112N/N445K | + |
| 8649/8650 | S64R/N445K | ++ |
| 8651/8652 | S64R/A134S | + |
| 8653/8654 | F109V/N115A/P118V | +++ |
| 8655/8656 | N65G/I112N/N445K | + |
| 8657/8658 | S64R/I112N | + |
| 8659/8660 | Q11L/N445K | + |
| 8661/8662 | N65G/I112N | + |
| 8663/8664 | V42G/I43M | + |
| 8665/8666 | V46T/N51Q | + |
| 8667/8668 | A141P | + |
| 8669/8670 | A73H/A141P | +++ |
| 8671/8672 | A141G | ++ |
| 8673/8674 | A73H/N302P | ++ |
| 8675/8676 | E71T/A73H/A141S | ++ |
| 8677/8678 | E71T | ++ |
| 8679/8680 | E71T/N302P | + |
| 8681/8682 | A73H | ++ |
| 8683/8684 | A73H/A141G | +++ |
| 8685/8686 | E71T/A141P | +++ |
| 8687/8688 | A141S/N302P | +++ |
| 8689/8690 | E71T/A73H/A141G | ++ |
| 8691/8692 | A73H/L116I/A141P | + |
| 8693/8694 | N302P | + |
| 8695/8696 | A73H/A141S | + |
| 8697/8698 | A141S | + |
| 8699/8700 | V46L/S47N/N51Q | ++ |
| 8701/8702 | V42A/Y44H/E71T/A73H/L116I | ++ |
| 8703/8704 | A141G/N302P | + |
| 8705/8706 | S47N/A49G | + |
| 8707/8708 | S47N/N51V | + |
| 8709/8710 | E71T/A73H | + |
| 8711/8712 | I43T/A73H/A141P | + |
| 8713/8714 | V287L/N288P | ++ |
| 8715/8716 | V287S/A398T | + |
| 8717/8718 | V287S/Q399K | +++ |
| 8719/8720 | Q127I/P169E/R172H | + |
| 8721/8722 | V376M/A398M | + |
| 8723/8724 | Q399K | +++ |
| 8725/8726 | V287S/V376M | + |
| 8727/8728 | A398R | ++ |
| 8729/8730 | V287M | ++ |
| 8731/8732 | A398M/Q399K/I420F | ++ |
| 8733/8734 | N288P/Q399K | +++ |
| 8735/8736 | Q127I/P169E/A398L/Q399K | +++ |
| 8737/8738 | V287L/Q399K | +++ |
| 8739/8740 | A398M | ++ |
| 8741/8742 | I420F | + |
| 8743/8744 | A398T/Q399K | + |
| 8745/8746 | Q127I/V287S | + |
| 8747/8748 | P169E/A398T | ++ |
| 8749/8750 | P169E/R172H/V287S | + |
| 8751/8752 | Q127I | + |
| 8753/8754 | V376M/Q399K | + |
| 8755/8756 | N288P/A398K | + |
| 8757/8758 | Q127I/P169E/V287S | ++ |
| 8759/8760 | Q127I/V376M | +++ |
| 8761/8762 | V376M | + |
| 8763/8764 | Q127I/P169E/V376M/A398M/Q399K | + |
| 8765/8766 | A398M/Q399K | ++ |
| 8767/8768 | A398L/Q399K | + |
| 8769/8770 | P169E/R172H/A398M/Q399K | ++ |
| 8771/8772 | V376M/A398L | ++ |

TABLE 59.1-continued

β1,2GT Round 19 Combinatorial Variants and RebM Levels

| SEQ ID NO: (nt/aa) | Amino Acid Differences (Relative to SEQ ID NO: 7784) | Increased RebM[a] |
|---|---|---|
| 8773/8774 | P169E/R172H/N288P | + |
| 8775/8776 | V287S | +++ |
| 8777/8778 | L116I/V287S | + |
| 8779/8780 | N288P | +++ |
| 8781/8782 | P169E/A398M/Q399K | ++ |
| 8783/8784 | A398R/Q399K | ++ |
| 8785/8786 | N288P/V376S/A398L | + |
| 8787/8788 | A398L | +++ |
| 8789/8790 | P169E/V287S | +++ |
| 8791/8792 | V287S/I420F/R423L/R427S | +++ |
| 8793/8794 | A398L/R427S | ++ |
| 8795/8796 | P169E/R172H/N288P/A398L/Q399K/I420F/R423L/R427S | + |

[a]Levels of increased production were determined relative to the reference polypeptide of SEQ ID NO: 7784, and defined as follows: "+" = production at least 1.1-fold, but less than 1.18-fold; "++" = at least 1.18-fold, but less than 1.24-fold; and "+++" = at least 1.24-fold increased production, as compared to the reference polypeptide.

TABLE 59.2

β1,2GT Round 19 Saturation Mutagenesis Variants and RebM Levels

| SEQ ID NO: (nt/aa) | Amino Acid Differences (Relative to SEQ ID NO: 7784) | Increased RebM[a] |
|---|---|---|
| 9107/9108 | Q127A | + |
| 9109/9110 | L16T | ++ |
| 9111/9112 | I331V | ++ |
| 9113/9114 | V15L/R394H | ++ |
| 9115/9116 | Y123A | ++ |
| 9117/9118 | I202Y | + |
| 9119/9120 | A22G | + |
| 9121/9122 | P143G | ++ |
| 9123/9124 | L16A | +++ |
| 9125/9126 | L116I/P143R | + |
| 9127/9128 | G198Q | +++ |
| 9129/9130 | F125L | +++ |
| 9131/9132 | V144S | +++ |
| 9133/9134 | F156V | + |
| 9135/9136 | Y268W | +++ |
| 9137/9138 | Q127G | +++ |
| 9139/9140 | G201K | +++ |
| 9141/9142 | I331C | + |
| 9143/9144 | L116I/M350L | ++ |
| 9145/9146 | L36M | + |
| 9147/9148 | G201A | + |
| 9149/9150 | L116I | ++ |
| 9151/9152 | N199S | ++ |
| 9153/9154 | H93A | + |
| 9155/9156 | Q127V | ++ |
| 9157/9158 | V144G | + |
| 9159/9160 | L16G | + |
| 9161/9162 | P197H | + |
| 9163/9164 | G201N | + |
| 9165/9166 | H324R | + |
| 9167/9168 | N199Y | + |
| 9169/9170 | Y123L | +++ |
| 9171/9172 | G201L | + |
| 9173/9174 | Y123V | ++ |
| 9175/9176 | L13Q | + |
| 9177/9178 | I202A | + |
| 9179/9180 | G10D/V144L | +++ |
| 9181/9182 | Y123S | +++ |
| 9183/9184 | V144Q | + |
| 9185/9186 | G186N | ++ |
| 9187/9188 | Y123G | + |
| 9189/9190 | L116I/Y123S | ++ |
| 9191/9192 | G96M | + |
| 9193/9194 | M350L | + |
| 9195/9196 | V287A | ++ |
| 9197/9198 | T187Y | + |
| 9199/9200 | M203T | ++ |
| 9201/9202 | R14Q | + |
| 9203/9204 | N199R | ++ |
| 9205/9206 | G89A | ++ |
| 9207/9208 | VI5A | ++ |
| 9209/9210 | G10D/N199G | +++ |
| 9211/9212 | L116I/Y123N | + |
| 9213/9214 | A149S | ++ |
| 9215/9216 | T187G | + |
| 9217/9218 | N199G | +++ |
| 9219/9220 | N199P | ++ |
| 9221/9222 | G10D | +++ |

[a]Levels of increased production were determined relative to the reference polypeptide of SEQ ID NO: 7784, and defined as follows:
"+" = production at least 1.1-fold, but less than 1.18-fold;
"++" = at least 1.18-fold, but less than 1.27-fold; and
"+++" = at least 1.27-fold increased production, as compared to the reference polypeptide.

Shake Flask Powder Characterization Assay and Analysis for Glucosyl Transfer from Sucrose to ADP to Rebaudioside A60

A shake flask powder loading dose response experiment was performed to characterize activity of the engineered round 19 variants on rebaudioside 60%. Levels of 0.0013-0.04 g/L shake flask powder (SFP) were assayed in 100 total reaction volume containing 50 mM potassium phosphate buffer, pH6, 20 g/L RebA60 or RebA97, 0.025 g/L ADP, 20 (single substrate) or 40 g/L (one-pot) sucrose, 0.04 g/L SUS SFP SEQ ID NO: 8420, and, for the one-pot reaction only, 0.15 g/L β-1,3-glycosyltransferase (β1,3GT) SFP SEQ ID NO: 8088. The reaction was performed at 60° C. in a Thermotron® titre-plate shaker at 300 RPM for 16-18 h. The reactions were diluted, quenched, and analyzed as described above. The production levels of rebaudioside D in the single substrate and rebaudioside M in the one-pot reactions by the round 19 variants at 0.0025 and 0.005 g/L SFP loading, respectively, are shown in Table 59.3. The variant with SEQ ID NO: 9180 was the most improved variant. Thus, it was selected as the best enzyme for the catalysis of glycosyl-transfer from ADP-glucose to rebaudioside A to form rebaudioside D.

TABLE 59.3

β1,2GT Round 19 Shake Flask Variants and RebD and RebM Levels

| SEQ ID NO: (nt/aa) | Amino Acid Differences (Relative to SEQ ID NO: 7784) | Increased RebD[a] | Increased RebM[a] |
|---|---|---|---|
| 8635/8636 | S64R/N65G/I112N | − | + |
| 8651/8652 | S64R/A134S | ++ | ++ |
| 8685/8686 | E71T/A141P | + | + |
| 8765/8766 | A398M/Q399K | + | + |
| 8789/8790 | P169E/V287S | − | + |
| 9131/9132 | V144S | + | ++ |
| 9169/9170 | Y123L | − | − |
| 9179/9180 | G10D/V144L | + | ++ |
| 9181/9182 | Y123S | − | − |

[a]Levels of increased production were determined relative to the reference polypeptide of SEQ ID NO: 7784, and defined as follows:
"−" = production less than that of the reference polypeptide;
"+" = production at least that of the reference polypeptide, but less than 1.1-fold; and
"++" = at least 1.1-fold increased production, as compared to the reference polypeptide.

Example 60

Beta-1,3-ADP-Glycosyltransferase Variants of SEQ ID NO: 696

In this Example, experiments for evolution and screening of β1,3-glycosyltransferase (GT) polypeptides derived from SEQ ID NO: 696 for improved glucosylation of steviol glycosides using ADP-glucose are described. Directed evolution of the GT encoded by SEQ ID NO: 695 (i.e., SEQ ID NO: 696) was carried out by constructing libraries of variant genes in which mutations associated with improved activity in previous rounds above were recombined and in which certain structural features were subjected to saturation mutagenesis. These libraries were then plated, grown, and screened using the high-throughput (HTP) assay described below to provide an eighth round ("Round 8") of 65 engineered GT variant polypeptides with glucosyltransferase activity toward ADP-glucose and steviol glycosides.

HTP Assay for Glucose Transfer from Sucrose to ADP and then from ADP-Glucose to Stevioside Assays were performed on 96-well plates of cleared E. coli culture lysates expressing SEQ ID NO: 695 variants. Pellets were lysed with 400 μL lysis buffer with 0.5 mg/mL lysozyme and 0.5 mg/mL PMBS in 25 mM Tris-HCl pH 7.5 for 1.5 h and cleared by centrifugation. Assays were conducted with 10 μL lysate in 100 μL reactions and with 5 mM rebaudioside D substrate, 0.2 mM ADP (Sigma, >93% purity) co-substrate, 0.1 g/L SUS SFP SEQ ID NO: 1222, and 15 mM sucrose (cane sugar). The following reaction conditions were used: 50 mM KPhos buffer, pH 7, 3 mM MgCl$_2$, 50° C. in a Thermotron® titre-plate shaker with 300 RPM shaking for 4-5 h. Then, reactions were solubilized by 20× dilution in water, quenched with 5× dilution in acetonitrile with 0.2% formic acid, centrifuged 10 m at 4° C., and supernatants were diluted 5× in water for analysis. Samples were analyzed by RapidFire-MS/MS as described in Example 31, Table 31.1. Glucosyltransferase variant polypeptides that produced rebaudioside M from rebaudioside D with with in situ synthesized ADP-glucose at greater quantities than SEQ ID NO: 696 were identified. Most were retested in triplicate on stevioside (95% purity). The engineered polypeptides are listed in Table 60.1. Shake-flask scale cultures were grown for SFP production as described in Example 31 for analysis of variants shown in Table 60.2 relative to SEQ ID NO: 696.

TABLE 60.1

β1,3GT Round 8 Variants and RebM and RebA Levels

| SEQ ID NO: (nt/aa) | Amino Acid Differences (Relative to SEQ ID NO: 696) | Increased RebM[a] | Increased RebA[a] |
|---|---|---|---|
| 4683/4684 | T262S/W401L | ++ | ND |
| 4685/4686 | I189L/M206K/K208A/V365I | ++ | ND |
| 4687/4688 | K185R/K208A/E230S/S252N/S255N/D290E/V365I | ++ | ND |
| 4689/4690 | V365I/W401L/V413L/V435Q | ++ | ND |
| 4691/4692 | K208A/V365I/V435Q | +++ | ND |
| 4693/4694 | S304P/P322S/V365I/W401L | ++ | ND |
| 4695/4696 | L249N | + | + |
| 4697/4698 | L249M | + | + |
| 4699/4700 | Q71R | + | + |
| 4701/4702 | L249S | + | + |
| 4703/4704 | I243L | + | + |
| 4705/4706 | K51A | + | ++ |
| 4707/4708 | K200N | + | + |
| 4709/4710 | L249Y | + | + |
| 4711/4712 | R308F | ++ | + |
| 4713/4714 | P339D | + | + |
| 4715/4716 | L249E | + | + |
| 4717/4718 | L78F | + | − |
| 4719/4720 | L78R | + | − |
| 4721/4722 | L249I | ++ | ++ |
| 4723/4724 | R88K | + | − |
| 4725/4726 | L78Q | + | − |
| 4727/4728 | L78I | + | − |
| 4729/4730 | C366A | + | + |
| 4731/4732 | F352Q | ++ | + |
| 4733/4734 | L245G | + | + |
| 4735/4736 | L78G | +++ | − |
| 4737/4738 | I25V | + | + |
| 4739/4740 | L78K | ++ | − |
| 4741/4742 | L78M | + | − |
| 4743/4744 | S374T | + | + |
| 4745/4746 | L249T | + | + |
| 4747/4748 | L78P | ++ | − |
| 4749/4750 | K200S | + | + |
| 4751/4752 | N56L | + | + |

TABLE 60.1-continued

β1,3GT Round 8 Variants and RebM and RebA Levels

| SEQ ID NO: (nt/aa) | Amino Acid Differences (Relative to SEQ ID NO: 696) | Increased RebM[a] | Increased RebA[a] |
|---|---|---|---|
| 4753/4754 | R308Y | ++ | − |
| 4755/4756 | H259Y | + | − |
| 4757/4758 | H259S | +++ | ND |
| 4759/4760 | T80L | +++ | ND |
| 4761/4762 | C366A | ++ | ND |
| 4763/4764 | P22L | + | − |
| 4765/4766 | I243M | ++ | + |
| 4767/4768 | I25L | +++ | + |
| 4769/4770 | L249H | ++ | − |
| 4771/4772 | I243C | + | + |
| 4773/4774 | S279G | +++ | +++ |
| 4775/4776 | H259G | ++ | + |
| 4777/4778 | L249P | ++ | ND |
| 4779/4780 | I243Y | + | − |
| 4781/4782 | L78P | +++ | ND |
| 4783/4784 | L362T | ++ | +++ |
| 4785/4786 | R88V | +++ | − |
| 4787/4788 | L78E | +++ | − |
| 4789/4790 | H81C | + | − |
| 4791/4792 | L78G | +++ | ND |
| 4793/4794 | I243V | ++ | ND |
| 4795/4796 | L157G | + | − |
| 4797/4798 | I243V | ++ | − |
| 4799/4800 | R88I | +++ | − |
| 4801/4802 | S364G | + | + |
| 4803/4804 | S282T | ++ | + |
| 4805/4806 | S284T | + | + |
| 4807/4808 | V338C | +++ | ++ |
| 4809/4810 | S364G | ++ | ND |
| 4811/4812 | L157Q | + | − |

[a]Levels of increased production were determined relative to the reference polypeptide of SEQ ID NO: 696, and defined as follows:
"−" = production less than that of the reference polypeptide;
"+" = production at least that of the reference polypeptide, but less than 1.24-fold;
"++" = at least 1.24-fold, but less than 1.49-fold; and
"+++" = at least 1.49-fold increased production, as compared to the reference polypeptide.
ND = not determined.

SFP Characterization Assay and Analysis for Glucosyl Transfer from ADP-Glucose to Stevioside or Rebaudioside D Shake flask powders (SFP) were reconstituted to a concentration of 20 g/L and diluted to 0.002-5 g/L SFP in 100 µL total reaction volumes of 50 mM potassium phosphate buffer, pH 7, with 3 mM $MgCl_2$, 1 mM stevioside (95% purity) or rebaudioside D, and 1 mM ADP-glucose (Sigma, >93% purity). The reactions were incubated at 50° C. in a Thermotron® titre-plate shaker with 300 RPM shaking for 1 hour. The reactions were solubilized by 5× dilution with water, quenched by 4× dilution in acetonitrile with 0.2% formic acid, cleared by centrifugation, and diluted 5× with water for analysis. Glycosylated products were detected in by SPE-QQQ as described in Example 31, Table 31.1.

TABLE 60.2

β1,3GT Round 8 Shake Flask Powder Variants and RebM and RebA Levels

| SEQ ID NO: (nt/aa) | Amino Acid Differences (Relative to SEQ ID NO: 696) | Increased RebM[a] | Increased RebA[a] |
|---|---|---|---|
| 4683/4684 | T262S/W401L | + | + |
| 4685/4686 | I189L/M206K/K208A/V365I | + | + |
| 4693/4694 | S304P/P322S/V365I/W401L | − | + |

[a]Levels of increased production were determined relative to the reference polypeptide of SEQ ID NO: 696, and defined as follows:
"−" = production less than that of the reference polypeptide; and
"+" = production at least that of the reference polypeptide, but less than 1.35-fold increased production, as compared reference polypeptide.

In these experiments, all of the variants in Table 60.2 (i.e., SEQ ID NOS: 4684, 4686, and 4694) produced rebaudioside A from stevioside and/or rebaudioside M from rebaudioside D with ADP-glucose at greater quantities than SEQ ID NO: 696. The variant SEQ ID NO: 4684 was selected for further directed evolution.

Example 61

Beta-1,3-ADP-Glycosyltransferase Variants of SEQ ID NO: 4684

In this Example, experiments for evolution and screening of β1,3-glycosyltransferase (β1,3GT) polypeptides derived from SEQ ID NO: 4684 for improved glucosylation of steviol glycosides using in situ synthesized ADP-glucose are described. Directed evolution of the GT encoded by SEQ ID NO: 4684 (i.e., SEQ ID NO: 4683) was carried out by constructing a library of variant genes in which mutations associated with improved activity in previous rounds above were recombined. These libraries were then plated, grown, and screened using the high-throughput (HTP) assay described below to provide a ninth round("Round 9") of 31 engineered GT variant polypeptides with glucosyltransferase activity toward ADP-glucose and steviol glycosides.

HTP Assay for Glucose Transfer from Sucrose to ADP and then from ADP-Glucose to Stevioside Assays were performed on 96-well plates of cleared E. coli culture lysates expressing SEQ ID NO: 4684 variants. Pellets were lysed, and lysate was cleared as described in Example 60. Assays were conducted with 10 µL lysate in 100 µL reactions and with 5 mM stevioside (>95% purity) substrate, 0.2 mM ADP (Sigma, >93% purity) co-substrate, 0.1 g/L SUS SFP SEQ ID NO: 1222, and 15 mM sucrose (cane sugar). The following reaction conditions were used: 50 mM KPhos buffer, pH 7, 3 mM $MgCl_2$, 50° C. in a Thermotron® titre-plate shaker with 300 RPM shaking for 4-5 h. Reactions were solubilized, quenched, and diluted as described in Example 60. Samples were analyzed by Rapid-Fire-MS/MS as described in Example 31, Table 31.1. Glycosyltransferase variant polypeptides that produced rebaudioside A from stevioside with in situ synthesized ADP-glucose at greater quantities than SEQ ID NO: 4684 were identified. The engineered polypeptides are listed in Table 61.1. Shake-flask scale cultures were grown, lysed, cleared, and lyophilized to powder as described in Example 31 for analysis of variants shown in Table 61.2 relative to SEQ ID NO: 4684.

SFP Characterization Assay and Analysis for Glucosyl Transfer from ADP-Glucose to Stevioside or Rebaudioside D Shake flask powders (SFP) were reconstituted to a concentration of 20 g/L and diluted to 0.002-5 g/L SFP in 100 µL total reaction volumes of 50 mM potassium phosphate buffer, pH7, with 3 mM $MgCl_2$, 1 mM stevioside (95% purity) or rebaudioside D, and 1 mM ADP-glucose (Sigma, >93% purity). The reactions were incubated at 50° C. in a Thermotron® titre-plate shaker with 300 RPM shaking for 1 hour. The reactions were solubilized by 5× dilution with water, quenched by 4× dilution with acetonitrile and 0.2% formic acid, cleared by centrifugation, and diluted 5× with water for analysis. Glycosylated products were detected in by SPE-QQQ as described in Example 31, Table 31.1.

TABLE 61.1

β1,3GT Round 9 Variants and RebA Levels

| SEQ ID NO: (nt/aa) | Amino Acid Differences (Relative to SEQ ID NO: 4684) | Increased RebA[a] |
|---|---|---|
| 4813/4814 | N56H/L249M/S284T/W353Y | + |
| 4815/4816 | K51A/I243L/L249E/R308F/W353Y | ++ |
| 4817/4818 | K51A/N56H/L249M/L362M/C366S | ++ |
| 4819/4820 | K51A/N56H/L249Y/W353Y | + |
| 4821/4822 | I243L/R308F/W353Y | +++ |
| 4823/4824 | K51A/L249Y/S284T/R308F/L362M/C366V | +++ |
| 4825/4826 | K51A/N56H/L249M/L362M/S364G | +++ |
| 4827/4828 | K51A/N56H/I243L/L249E/R308F/L362M/S364G | +++ |
| 4829/4830 | N56H/I243L/S364G/C366V | ++ |
| 4831/4832 | N56H/L249M/W353Y | ++ |
| 4833/4834 | N56H/L249Y | +++ |
| 4835/4836 | R308F/C366A | ++ |
| 4837/4838 | N56H/I243L/L249E/S282T/S364G/C366V | +++ |
| 4839/4840 | K51A/L249M | + |
| 4841/4842 | N56H | + |
| 4843/4844 | K51A/L249M/S282T/W353Y/C366S | ++ |
| 4845/4846 | K51A/L249E/W353Y/L362M/S364G | + |
| 4847/4848 | N56H/S284T/C366V | + |
| 4849/4850 | I243L/S282T/W353Y/L362M/S364G | + |
| 4851/4852 | K51A/W353Y/L362M | + |
| 4853/4854 | K51A/N56H | + |
| 4855/4856 | I243L/L249E/S282T/S284T/L362M/S364G/C366S | ++ |
| 4857/4858 | S282T | + |
| 4859/4860 | I243L/L249M/R308F/W353Y/C366A | + |
| 4861/4862 | K51A/N56H/I243L/L249E/S282T/W353Y/L362M/C366S | + |
| 4863/4864 | I243L/S282T/L362M/S364G/C366V | ++ |
| 4865/4866 | K51A/L249M/S282T/S284T/S364G | + |
| 4867/4868 | L249Y/W353Y/L362M/C366S | + |
| 4869/4870 | L362M/C366A | + |
| 4871/4872 | I243L/L249Y/W353Y/L362M/C366S | + |
| 4873/4874 | K51A/I243L/L249E/A348S/L362M/C366V | ++ |

[a]Levels of increased production were determined relative to the reference polypeptide of SEQ ID NO: 4684, and defined as follows:?
"+" = production at least 1.2-fold, but less than 1.42-fold;
"++" = at least 1.42-fold, but less than 1.59-fold; and
"+++" = at least 1.59-fold increased production, as compared to the reference polypeptide.

TABLE 61.2

β1,3GT Round 9 Shake Flask Powder Variants and RebM and RebA Levels

| SEQ ID NO: (nt/aa) | Amino Acid Differences (Relative to SEQ ID NO: 4684) | Increased RebA[a] | Increased RebM[a] |
|---|---|---|---|
| 4837/4838 | N56H;I243L;L249E;S282T;S364G;C366V; | ++ | +++ |
| 4821/4822 | I243L;R308F;W353Y; | + | ++ |
| 4825/4826 | K51A;N56H;L249M;L362M;S364G; | + | ++ |
| 4823/4824 | K51A;L249Y;S284T;R308F;L362M;C366V; | + | ++ |
| 4833/4834 | N56H;L249Y; | + | + |

[a]Levels of increased production were determined relative to the reference polypeptide of SEQ ID NO: 4684, and defined as follows:
"+" = production at least that of the reference polypeptide, but less than 1.4-fold;
"++" = at least 1.4-fold, but less than 2-fold; and
"+++" = at least 2-fold increased production, as compared to the reference polypeptide.

In these experiments, all of the variants in Table 61.2 (i.e., SEQ ID NOS: 4822, 4824, 4826, 4834, and 4838) produced rebaudioside A from stevioside and rebaudioside M from rebaudioside D with ADP-glucose at greater quantities than SEQ ID NO: 4684. The variant of SEQ ID NO: 4838 had the highest activity on both stevioside and rebaudioside D with ADP-glucose as a co-substrate in these experiments. Thus, the encoding polynucleotide (SEQ ID NO: 4837) was selected for further directed evolution.

Example 62

Beta-1,3-ADP-Glycosyltransferase Variants of SEQ ID NO: 4838

In this Example, experiments for evolution and screening of β1,3-glycosyltransferase (β1,3GT) polypeptides derived from SEQ ID NO: 4838 for improved glucosylation of steviol glycosides using in situ synthesized ADP-glucose are described. Directed evolution of the GT encoded by SEQ ID NO: 4837 (i.e., SEQ ID NO: 4838) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide a tenth round ("Round 10") of 123 engineered GT variant polypeptides with glucosyltransferase activity toward ADP-glucose and steviol glycosides.

HTP Assay for Glucose Transfer from Sucrose to ADP and then from ADP-Glucose to Rebaudioside D Assays were performed on 96-well plates of cleared E. coli culture lysates expressing SEQ ID NO: 4838 variants. Pellets were lysed, and the lysate was cleared as described in Example 60, and then diluted 4× into potassium phosphate buffer, pH 6.5. Assays were conducted with 10 µL lysate in 100 µL reactions and with 5 mM stevioside (>95% purity) substrate, 0.2 mM ADP (Sigma, >93% purity) co-substrate, 0.2 g/L SUS SFP SEQ ID NO: 1222, and 15 mM sucrose (cane sugar). The following reaction conditions were used: 50 mM potassium phosphate buffer, pH 6.5, 50° C. in a Thermotron® titre-plate shaker with 300 RPM shaking for 1 h. Reactions were solubilized, quenched, and diluted as described in Example 60. Samples were analyzed by RapidFire-MS/MS as described in Example 1, Table 1.1. Selected variants were retested in a similar assay with 10× lysate dilution, 4 mM stevioside or rebaudioside D, 0.375 mM ADP, 0.5 g/L sucrose synthase SEQ ID NO: 1392, 30 mM sucrose, and 2 h incubation. Glycosyltransferase variant polypeptides that produced rebaudioside M from rebaudioside D with in situ synthesized ADP-glucose at greater quantities than SEQ ID NO: 4838 were identified. The engineered polypeptides are listed in Table 62.1. Shake-flask scale cultures were grown, lysed, cleared, and lyophilized to powder as described in Example 1 for analysis of variants shown in Table 62.2 relative to SEQ ID NO: 4838.

TABLE 62.1

β1,3GT Round 10 Variants and RebM and RebA Levels

| SEQ ID NO: (nt/aa) | Amino Acid Differences (Relative to SEQ ID NO: 4838) | Increased RebA[a] | Increased RebM[a] |
|---|---|---|---|
| 4875/4876 | K51A/H56L/L362M | +++ | +++ |
| 4877/4878 | Q177S | ++ | ++ |
| 4879/4880 | K51A | ++ | ++ |
| 4881/4882 | H56L/L362M/V366A | ++ | +++ |
| 4883/4884 | H56L/L243M/E249Y | +++ | +++ |
| 4885/4886 | K208E | ++ | ++ |
| 4887/4888 | A110S | ++ | +++ |
| 4889/4890 | K439D | ++ | + |
| 4891/4892 | H56L/L243M/E249M | +++ | +++ |
| 4893/4894 | K208I | ++ | ++ |
| 4895/4896 | Q265A | ++ | +++ |
| 4897/4898 | K208W/V320I | +++ | ++ |
| 4899/4900 | K208L | ++ | ++ |
| 4901/4902 | K200S/L243M/E249Y/H259G | ++ | +++ |
| 4903/4904 | K336E | ++ | +++ |
| 4905/4906 | K208T | ++ | +++ |
| 4907/4908 | K222P | +++ | +++ |
| 4909/4910 | H259N | ++ | ++ |
| 4911/4912 | K289H | ++ | +++ |

TABLE 62.1-continued

β1,3GT Round 10 Variants and RebM and RebA Levels

| SEQ ID NO: (nt/aa) | Amino Acid Differences (Relative to SEQ ID NO: 4838) | Increased RebA[a] | Increased RebM[a] |
|---|---|---|---|
| 4913/4914 | R234T | ++ | ++ |
| 4915/4916 | W353Y/L362M | − | + |
| 4917/4918 | L174S | + | + |
| 4919/4920 | H259S | ++ | ++ |
| 4921/4922 | I25V/L362M/V366S | − | + |
| 4923/4924 | E226R | + | + |
| 4925/4926 | K171V | + | + |
| 4927/4928 | R234E | + | ++ |
| 4929/4930 | R88I | − | +++ |
| 4931/4932 | L256A | + | + |
| 4933/4934 | E175N | + | ++ |
| 4935/4936 | V428K | + | + |
| 4937/4938 | E226T | + | + |
| 4939/4940 | K439Q | ++ | + |
| 4941/4942 | E405Q | + | + |
| 4943/4944 | R88C/R173S | − | +++ |
| 4945/4946 | I198S | − | +++ |
| 4947/4948 | K208G | + | + |
| 4949/4950 | L163K | + | + |
| 4951/4952 | I198D/F313S | − | + |
| 4953/4954 | R234A | + | + |
| 4955/4956 | K171D | + | + |
| 4957/4958 | Q177P | + | + |
| 4959/4960 | I198E | − | +++ |
| 4961/4962 | A85E | − | ++ |
| 4963/4964 | Q209E/R234Q | + | + |
| 4965/4966 | K51A/H56L/K200S/L243M/E249I/H259G/V338C | ++ | +++ |
| 4967/4968 | K208N | + | ++ |
| 4969/4970 | I25L/H56L/W353Y | + | ++ |
| 4971/4972 | I198D/F313S/V428S | − | ++ |
| 4973/4974 | R411T | + | +++ |
| 4975/4976 | R234H/N408D | + | + |
| 4977/4978 | I198D | − | +++ |
| 4979/4980 | P322V | + | + |
| 4981/4982 | Q177K | + | + |
| 4983/4984 | Q209A | + | + |
| 4985/4986 | K51A/Q71R/E249M/S279G/S284T/L362M/V366S | + | +++ |
| 4987/4988 | K171E | + | ++ |
| 4989/4990 | K289T | + | + |
| 4991/4992 | K171P | + | + |
| 4993/4994 | L243M/V338C/L362M/V366S | + | ++ |
| 4995/4996 | P272D | + | + |
| 4997/4998 | Q159N | + | ++ |
| 4999/5000 | H259T | + | + |
| 5001/5002 | P70S/I198D/H259E/F313S | − | ++ |
| 5003/5004 | I25L | + | ++ |
| 5005/5006 | I25V/L243M/E249Y/H259G/V366A | + | +++ |
| 5007/5008 | S253A | + | + |
| 5009/5010 | I25V/L243M/E249I/L362M | + | +++ |
| 5011/5012 | L174E | + | ++ |
| 5013/5014 | K208V | + | + |
| 5015/5016 | I198T | − | + |

[a]Levels of increased production were determined relative to the reference polypeptide of SEQ ID NO: 4838, and defined as follows:
"−" = production less than that of the reference polypeptide;
"+" = production at least that of the reference polypeptide, but less than 1.34-fold;
"++" = at least 1.34-fold, but less than 1.54-fold; and
"+++" = at least 1.54-fold increased production, as compared to the reference polypeptide.

SFP Characterization Assay and Analysis for Glucosyl Transfer from ADP-Glucose to Stevioside or Rebaudioside D Shake flask powders (SFP) were reconstituted to a concentration of 20 g/L and diluted to 0.006-0.2 g/L SFP in 100 µL total reaction volumes of 50 mM potassium phosphate buffer, pH 6.5, 1 mM stevioside (95% purity) or rebaudioside D, and 1 mM ADP-glucose (Sigma, >93% purity). The reactions were incubated at 50° C. in a Thermotron® titre-plate shaker with 300 RPM shaking for 1 hour. The reactions were solubilized by 5× dilution with water, quenched by 4× dilution with acetonitrile and 0.2% formic acid, cleared by centrifugation, and diluted 5× with water for analysis. Glycosylated products were detected in by SPE-QQQ as described in Example 31, Table 31.1.

TABLE 62.2

β1,3GT Round 10 Shake Flask Powder Variants and RebA and RebM Levels

| SEQ ID NO: (nt/aa) | Amino Acid Differences (Relative to SEQ ID NO: 4838) | Increased RebA[a] | Increased RebM[a] |
|---|---|---|---|
| 4875/4876 | K51A/H56L/L362M | + | + |
| 4879/4880 | L243M/V338C/L362M/V366S | − | + |
| 4881/4882 | K200S/L243M/E249Y/H259G | − | − |

TABLE 62.2-continued

β1,3GT Round 10 Shake Flask Powder Variants and RebA and RebM Levels

| SEQ ID NO: (nt/aa) | Amino Acid Differences (Relative to SEQ ID NO: 4838) | Increased RebA[a] | Increased RebM[a] |
|---|---|---|---|
| 4909/4910 | I198D/F313S | − | ++ |
| 4911/4912 | P70S/I198D/H259E/F313S | − | − |

[a]Levels of increased production were determined relative to the reference polypeptide of SEQ ID NO: 4838, and defined as follows:
"−" = production less than that of the reference polypeptide; and
"+" = production at least that of the reference polypeptide, but less than 1.3-fold increased production, as compared to the reference polypeptide.

In these experiments, one variant in Table 62.2 (i.e., SEQ ID NO: 4876) produced rebaudioside A from stevioside and rebaudioside M from rebaudioside D with ADP-glucose at greater quantities than SEQ ID NO: 4838. Thus, the encoding polynucleotide (SEQ ID NO: 4875) was selected for further directed evolution.

Example 63

Beta-1,3-ADP-Glycosyltransferase Variants of SEQ ID NO: 4876

In this Example, experiments for evolution and screening of β1,3-glycosyltransferase (β1,3GT) polypeptides derived from SEQ ID NO: 4876 for improved glucosylation of steviol glycosides using in situ synthesized ADP-glucose are described. Directed evolution of the GT encoded by SEQ ID NO: 4875 (i.e., SEQ ID NO: 4876) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide an eleventh round ("Round 11") of 122 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared *E. coli* culture lysates expressing SEQ ID NO: 4875 variants. Pellets were lysed, and lysate was cleared as described in Example 60, and then diluted 10× into potassium phosphate buffer, pH 6.5. Assays of combinatorial libraries were conducted with 10 μL lysate in 100 μL reactions and with 4 mM stevioside (>95% purity) or rebaudioside D substrate, 0.2 mM ADP (Sigma, >93% purity) co-substrate, 0.2 g/L SUS SFP SEQ ID NO: 1456, and 24 mM sucrose (cane sugar). The following reaction conditions were used: 50 mM potassium phosphate buffer, pH 6.5, 50° C. in a Thermotron® titre-plate shaker with 300 RPM shaking for 1 h. Reactions were solubilized, quenched, and diluted as described in Example 60. Samples were analyzed by RapidFire-MS/MS as described in Example 1, Table 1.1. For the saturation mutagenesis library, the same assay was performed but with 5× diluted lysate, pH 6 potassium phosphate buffer, and 1-2 incubation at 55° C. Selected variants were also retested in triplicate under these conditions. Glycosyltransferase variant polypeptides that produced rebaudioside A/rebaudioside M from stevioside/rebaudioside D with in situ synthesized ADP-glucose at greater quantities than SEQ ID NO: 4876 were identified. The engineered polypeptides are listed in Table 63.1. Shake-flask scale cultures were grown, lysed, cleared, and lyophilized to powder as described in Example 1 for analysis of variants shown in Table 63.2 relative to SEQ ID NO: 4876.

TABLE 63.1

β1,3GT Round 11 Variants and RebM and RebA Levels

| SEQ ID NO: (nt/aa) | Amino Acid Differences (Relative to SEQ ID NO: 4876) | Increased RebM[a] | Increased RebA[a] |
|---|---|---|---|
| 5017/5018 | I25L/Q209E/L243M/H259G | + | ++ |
| 5019/5020 | Q209E/E249M/V338C | ++ | ++ |
| 5021/5022 | I198D/K200S/Q209E/L243M/E249Y/K289T | ++ | − |
| 5023/5024 | I25L/E249I | ++ | ++ |
| 5025/5026 | I25L/Q209E/E249I/H259G/V366A | ++ | ++ |
| 5027/5028 | K200S/Q209E/V366A | ++ | + |
| 5029/5030 | I25L/Q209E/H259G | ++ | ++ |
| 5031/5032 | I25L/H259G/S279G/K289T | ++ | ++ |
| 5033/5034 | I25L/S279G/S284T/K289T | + | ++ |
| 5035/5036 | I198D | ++ | − |
| 5037/5038 | I25L/Q209E/S279G/V366A | + | ++ |
| 5039/5040 | S279G | ++ | ++ |
| 5041/5042 | I25L/H259G/S279G | ++ | ++ |
| 5043/5044 | Q209E/E249Y/S279G/S284T/K289T | + | ++ |
| 5045/5046 | I25L/Q209E/K289T/V366A | ++ | ++ |
| 5047/5048 | V366A | + | ++ |
| 5049/5050 | E249M/H259G | + | ++ |
| 5051/5052 | Q209E/E249I/H259G/K289T | ++ | ++ |
| 5053/5054 | K289T | ++ | ++ |
| 5055/5056 | Q209E/S279G/K289T | ++ | ++ |
| 5057/5058 | I25L/Q209E/L243M/E249Y | ++ | ++ |
| 5059/5060 | I25L/K200S/L243M/E249M | ++ | + |
| 5061/5062 | I25L | ++ | + |
| 5063/5064 | Q209E | ++ | ++ |
| 5065/5066 | Q209E/E249Y/H259G/S279G/V338C/V366A | +++ | +++ |
| 5067/5068 | I25L/K200S/Q209E/V338C | ++ | ++ |
| 5069/5070 | H259G/V366A | ++ | + |
| 5071/5072 | I25H/Q209E/L243M/E249Y | ++ | + |
| 5073/5074 | Q209E/V366A | +++ | ++ |
| 5075/5076 | I25L/I198D/Q209E | +++ | − |
| 5077/5078 | V338C | ++ | ++ |

TABLE 63.1-continued

β1,3GT Round 11 Variants and RebM and RebA Levels

| SEQ ID NO: (nt/aa) | Amino Acid Differences (Relative to SEQ ID NO: 4876) | Increased RebM[a] | Increased RebA[a] |
|---|---|---|---|
| 5079/5080 | I25L/K289T | ++ | ++ |
| 5081/5082 | I25L/S279G/S284T | ++ | ++ |
| 5083/5084 | S279G/V338C | ++ | ++ |
| 5085/5086 | I198D/E249M/V338C | ++ | − |
| 5087/5088 | I25L/Q209E/L243M | ++ | ++ |
| 5089/5090 | K53R | ++ | + |
| 5091/5092 | R308T | + | ND |
| 5093/5094 | G364S | + | ++ |
| 5095/5096 | R308C | + | ND |
| 5097/5098 | T54P | + | ND |
| 5099/5100 | R308L | ++ | ++ |
| 5101/5102 | S55W | + | ND |
| 5103/5104 | K53C | + | + |
| 5105/5106 | K53L | + | ND |
| 5107/5108 | K336Y | + | ND |
| 5109/5110 | K247L | ++ | ++ |
| 5111/5112 | K53V | ++ | ++ |
| 5113/5114 | Q341V | + | ND |
| 5115/5116 | K247A | ++ | + |
| 5117/5118 | S55T | ++ | ++ |
| 5119/5120 | E342R | + | ND |
| 5121/5122 | K336M | + | + |
| 5123/5124 | T54V | ++ | ++ |
| 5125/5126 | L107A | ++ | + |
| 5127/5128 | S252Q | + | + |
| 5129/5130 | S254G | + | + |
| 5131/5132 | A426T | + | ND |
| 5133/5134 | R411S | + | ND |
| 5135/5136 | S252E | ++ | ++ |
| 5137/5138 | K392H | ++ | ++ |
| 5139/5140 | S194Q | + | ND |
| 5141/5142 | V34I | + | ND |
| 5143/5144 | L107T | ++ | + |
| 5145/5146 | S253G | ++ | + |
| 5147/5148 | L107C | + | + |
| 5149/5150 | P322M | + | ND |
| 5151/5152 | K392Q | + | + |
| 5153/5154 | G297A | + | ND |
| 5155/5156 | F327L | ++ | + |
| 5157/5158 | T61S | ++ | ++ |
| 5159/5160 | L174M | + | ND |
| 5161/5162 | T8D | + | ND |
| 5163/5164 | R411E | + | ND |
| 5165/5166 | M414L | + | ND |
| 5167/5168 | R412T | + | ND |
| 5169/5170 | S388V | + | ND |
| 5171/5172 | P322T | ++ | + |
| 5173/5174 | S111G | + | + |
| 5175/5176 | S446F | + | ND |
| 5177/5178 | K432T | + | ND |
| 5179/5180 | S253P | + | + |
| 5181/5182 | L141M | + | ND |
| 5183/5184 | K430R | + | ND |
| 5185/5186 | V9G | + | ND |
| 5187/5188 | S254M | ++ | ++ |
| 5189/5190 | S252A | + | ND |
| 5191/5192 | P322R | ++ | ND |
| 5193/5194 | A238K | + | ND |
| 5195/5196 | E321D | ++ | ND |
| 5197/5198 | L256D | + | + |
| 5199/5200 | L256T | + | ND |
| 5201/5202 | M108C | + | ND |
| 5203/5204 | S111C | + | ND |
| 5205/5206 | L256W | + | ND |
| 5207/5208 | R234H/G297A | + | ND |
| 5209/5210 | S254P | + | + |
| 5211/5212 | S449L | + | + |
| 5213/5214 | T8L | + | ND |
| 5215/5216 | R412H | + | ND |
| 5217/5218 | S388T | + | + |
| 5219/5220 | D69S | + | + |
| 5221/5222 | P79S | + | − |
| 5223/5224 | E201T | + | + |
| 5225/5226 | I91R | + | + |
| 5227/5228 | P70K | + | − |

TABLE 63.1-continued

β1,3GT Round 11 Variants and RebM and RebA Levels

| SEQ ID NO: (nt/aa) | Amino Acid Differences (Relative to SEQ ID NO: 4876) | Increased RebM[a] | Increased RebA[a] |
|---|---|---|---|
| 5229/5230 | D69T | ++ | + |
| 5231/5232 | W87R | ++ | − |
| 5233/5234 | I91T | + | + |
| 5235/5236 | P79V | + | − |
| 5237/5238 | D69N | ++ | + |
| 5239/5240 | P158Q | + | + |
| 5241/5242 | I91Q | + | − |
| 5243/5244 | W87M | ++ | − |
| 5245/5246 | E73S | ++ | + |
| 5247/5248 | K190R | ++ | ++ |
| 5249/5250 | A153S | ++ | ++ |
| 5251/5252 | E201P | + | ++ |
| 5253/5254 | P79G | + | − |
| 5255/5256 | W87L | ++ | − |
| 5257/5258 | D69Q | + | + |
| 5259/5260 | K205P | − | ++ |

[a]Levels of increased production were determined relative to the reference polypeptide of SEQ ID NO: 4876, and defined as follows:
"−" = production less than that of the reference polypeptide;
"+" = production at least that of the reference polypeptide, but less than 1.2-fold;
"++" = at least 1.2-fold, but less than 2-fold; and
"+++" = at least 2-fold increased production, as compared to the reference polypeptide.
ND = not determined.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.006-0.2 g/L SFP in 100 μL total reaction volumes of 50 mM potassium phosphate buffer, pH 6.5, 4 mM stevioside (95% purity) or rebaudioside D, 0.2 mM ADP (Sigma, >93% purity) co-substrate, 0.2 g/L SUS SFP SEQ ID NO: 1456, and 24 mM sucrose (cane sugar). The reactions were incubated at 50° C. in a Thermotron® titre-plate shaker with 300 RPM shaking for 1 hour. The reactions were solubilized by 20× dilution with water, quenched by 5× dilution in acetonitrile with 0.2% formic acid, cleared by centrifugation, and diluted 5× with water for analysis. Glycosylated products were detected in by SPE-QQQ as described in Example 31, Table 31.1.

TABLE 63.2

β1,3GT Round 11 Shake Flask Powder Variants and RebA and RebM Levels

| SEQ ID NO: (nt/aa) | Amino Acid Differences (Relative to SEQ ID NO: 4876) | Increased RebA[a] | Increased RebM[a] |
|---|---|---|---|
| 5075/5076 | I25L/I198D/Q209E | − | +++ |
| 5041/5042 | I25L/H259G/S279G | ++ | +++ |
| 5025/5026 | I25L/Q209E/E249I/H259G/V366A | + | ++ |
| 5065/5066 | Q209E/E249Y/H259G/S279G/V338C/V366A | ++ | ++ |
| 5073/5074 | Q209E/V366A | + | ++ |
| 5043/5044 | Q209E/E249Y/S279G/S284T/K289T | + | + |

[a]Levels of increased production were determined relative to the reference polypeptide of SEQ ID NO: 4876, and defined as follows:
"−" = production less than that of the reference polypeptide;
"+" = production at least that of the reference polypeptide, but less than 1.3-fold;
"++" = at least 1.3-fold, but less than 1.8-fold; and
"+++" = at least 1.8-fold increased production, as compared to the reference polypeptide.

In these experiments, the six variants in Table 63.2 (i.e., SEQ ID NO: 5076, 5042, 5026, 5066, 5074, and 5044) produced rebaudioside A from stevioside and/or rebaudioside M from rebaudioside D with ADP-glucose at greater quantities than SEQ ID NO: 4876. SEQ ID NO: 5066 performed best in the primary screen (Table 63.1) and had the most beneficial mutations. Thus, the encoding polynucleotide (SEQ ID NO: 5065) was selected for further directed evolution. The variant with SEQ ID NO: 5076 was used for process development due to its high RebD to RebM activity.

Example 64

Beta-1,3-ADP-Glycosyltransferase Variants of SEQ ID NO: 5066

In this Example, experiments for evolution and screening of β1,3-glycosyltransferase (β1,3GT) polypeptides derived from SEQ ID NO: 5066 for improved glucosylation of steviol glycosides using in situ synthesized ADP-glucose are described. Directed evolution of the GT encoded by SEQ ID NO: 5065 (i.e., SEQ ID NO: 5066) was carried out by constructing libraries of variant genes in which mutations associated with improved production identified during the development of the present invention were recombined. These libraries were then plated, grown, and screened using the high-throughput (HTP) assay described below to provide a twelfth round ("Round 12") of 40 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared *E. coli* culture lysates expressing SEQ ID NO: 5066 variants. synthesized ADP-glucose at greater quantities than SEQ ID NO: 5066 were identified. The engineered polypeptides are listed in Table 64.1. Shake-flask scale cultures were grown, lysed, cleared, and lyophilized to powder as described in Example 31 for analysis of variants shown in Table 64.2 relative to SEQ ID NO: 5066.

TABLE 64.1

β1,3GT Round 12 Variants and RebA and RebM Levels

| SEQ ID NO: (nt/aa) | Amino Acid Differences (Relative to SEQ ID NO: 5066) | Increased RebA[a] | Increased RebM[a] |
|---|---|---|---|
| 5261/5262 | I198E/G259E | − | +++ |
| 5263/5264 | I198D/R234Q | + | ++ |
| 5265/5266 | Q159N/G259E/R411T | + | + |
| 5267/5268 | R88I/Q159N/I198D | − | ++ |
| 5269/5270 | G259E | + | ++ |
| 5271/5272 | R88I/A110D/R234T | − | ++ |
| 5273/5274 | I198D | + | +++ |
| 5275/5276 | I198E/K200S | + | ++ |
| 5277/5278 | R88I | − | ++ |
| 5279/5280 | R88I/I198D/G259E | − | +++ |
| 5281/5282 | R88I/I198D/K200S/G259E | + | ++ |
| 5283/5284 | R88I/A110D | − | ++ |
| 5285/5286 | R88I/G259N | − | ++ |
| 5287/5288 | R88I/A110D/Q159N/I198D/R234T/G259N/Q265A | − | ++ |
| 5289/5290 | R88I/A110D/Q159N/I198D/G259E | + | +++ |
| 5291/5292 | R88I/G259E/Q265A | − | ++ |
| 5293/5294 | Q159N/I198E/R411T | − | ++ |
| 5295/5296 | A110D/G259N/Q265A/R411T | + | + |
| 5297/5298 | R88I/A110D/Q159N/I198E/K200S | − | +++ |
| 5299/5300 | R88I/A110D/I198S | − | +++ |
| 5301/5302 | R88I/A110D/I198D | − | +++ |
| 5303/5304 | R234E | + | − |
| 5305/5306 | R88I/I198S | − | ++ |
| 5307/5308 | I198D/K200S/R234E | + | − |
| 5309/5310 | V320I/V428K | + | ++ |
| 5311/5312 | K208E/V320I/V428K | + | ++ |
| 5313/5314 | K171E/K208E/V320I | + | +++ |
| 5315/5316 | K171P/Q177P | + | ++ |
| 5317/5318 | L174E/V320I | + | ++ |
| 5319/5320 | K171P/L174E/E175N/Q177P/K208W/V320I/V428K/K439D | + | − |
| 5321/5322 | V428K | + | − |
| 5325/5326 | L174E/E175N/Q177P/K208E/V320I/V428K | − | ++ |
| 5327/5328 | K171E/K208E/V428K | + | ++ |
| 5329/5330 | K171E/Q177P/E226T/V428K/K439D | + | − |
| 5331/5332 | K171P/E175N/Q177P/K208L/V320I/V428K | + | + |
| 5333/5334 | K208E/V428K | − | ++ |
| 5335/5336 | K171E/K208E/V320I/V428K | + | +++ |
| 5337/5338 | L174E/E175N/V428K | + | − |
| 5339/5340 | K208E | + | + |
| 5341/5342 | K208L/V320I/R331C/V428K | + | − |

[a]Levels of increased production were determined relative to the reference polypeptide of SEQ ID NO: 5066, and defined as follows:
"−" = production less than that of the reference polypeptide;
"+" = production at least that of the reference polypeptide, but less than 1.35-fold;
"++" = at least 1.35-fold, but less than 1.8-fold; and
"+++" = at least 1.8-fold increased production, as compared to the reference polypeptide.

Pellets were lysed, and the lysate was cleared as described in Example 60, and then diluted 10× into potassium phosphate buffer, pH 6. Assays of combinatorial libraries were conducted with 10 µL lysate in 100 µL reactions and with 4 mM stevioside (>95% purity) or rebaudioside D substrate, 0.2 mM ADP (Sigma, >93% purity) co-substrate, 0.15 g/L SUS SFP SEQ ID NO: 1582, and 24 mM sucrose (cane sugar). The following reaction conditions were used: 50 mM potassium phosphate buffer, pH 6, 55° C. in a Thermotron® titre-plate shaker with 300 RPM shaking for 2 h. Reactions were solubilized, quenched, and diluted as described in Example 63. Samples were analyzed by RapidFire-MS/MS as described in Example 31, Table 31.1. Glycosyltransferase variant polypeptides that produced rebaudioside A/rebaudioside M from stevioside/rebaudioside D with in situ SFP Characterization Assay and Analysis for Glucosyl Transfer from Sucrose to ADP and then from ADP-Glucose to (Stevioside and Rebaudioside D Shake flask powders (SFP) were reconstituted to a concentration of 20 g/L and diluted to 0.006-0.2 g/L SFP in 100 µL total reaction volumes of 50 mM potassium phosphate buffer, pH6, 4 mM stevioside (95% purity) or rebaudioside D, 0.4 mM ADP (Sigma, >93% purity) co-substrate, 0.15 g/L SUS SFP SEQ ID NO: 1582, and 24 mM sucrose (cane sugar). The reactions were incubated at 55° C. in a Thermotron® titre-plate shaker with 300 RPM shaking for 1 hour. The reactions were solubilized by 20× dilution with water, quenched by 5× dilution in acetonitrile with 0.2% formic acid, cleared by centrifugation, and diluted 5× with water for analysis. Glycosylated products were detected in by SPE-QQQ as described in Example 31, Table 31.1.

TABLE 64.2

β1,3GT Round 12 Shake Flask Powder Variants and RebA and RebM Levels

| SEQ ID NO: (nt/aa) | Amino Acid Differences (Relative to SEQ ID NO: 5066) | Increased RebA[a] | Increased RebM[a] |
|---|---|---|---|
| 5279/5280 | R88I/I198D/G259E | − | ++ |
| 5289/5290 | R88I/A110D/Q159N/I198D/G259E | − | +++ |
| 5301/5302 | R88I/A110D/I198D | − | ++ |
| 5313/5314 | K171E/K208E/V320I | + | + |
| 5323/5324 | V320I/V428K | + | + |

[a]Levels of increased production were determined relative to the reference polypeptide of SEQ ID NO: 5066, and defined as follows:
"−" = production less than 0.95-fold;
"+" = production at least 0.95-fold, but less than 1.2-fold;
"++" = at least 1.2-fold, but less than 1.9-fold; and
"+++" = at least 1.9-fold increased production, as compared to the reference polypeptide.

In these experiments, the six variants in Table 64.2 (i.e., SEQ ID NO: 5280, 5290, 5302, 5314, 5324 produced rebaudioside A from stevioside and/or rebaudioside M from rebaudioside D with ADP-glucose at greater quantities than SEQ ID NO: 5066. SEQ ID NO: 5290 performed best on rebaudioside D and had the most beneficial mutations. Thus, the encoding polynucleotide (SEQ ID NO: 5289) was selected for further directed evolution.

Example 65

Beta-1,3-ADP-Glycosyltransferase Variants of SEQ ID NO: 5290

In this Example, experiments for evolution and screening of β1,3-glycosyltransferase (β1,3GT) polypeptides derived from SEQ ID NO: 5290 for improved glucosylation of steviol glycosides using in situ synthesized ADP-glucose are described. Directed evolution of the GT encoded by SEQ ID NO: 5289 (i.e., SEQ ID NO: 5290) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide a thirteenth round ("Round 13") of 100 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared E. coli culture lysates expressing SEQ ID NO: 5289 variants. Pellets were lysed, and lysate was cleared as described in Example 60, and then diluted 5× into potassium phosphate buffer, pH 6. Assays were conducted with 10 μL lysate in 100 μL reactions and with 4 mM stevioside (>95% purity) or rebaudioside D substrate, 0.2 mM ADP (Sigma, >93% purity) co-substrate, 0.15 g/L SUS SFP SEQ ID NO: 1764, and 24 mM sucrose (cane sugar). The following reaction conditions were used: 50 mM potassium phosphate buffer, pH 6, 55° C. in a Thermotron® titre-plate shaker with 300 RPM shaking for 2 h. Reactions were solubilized, quenched, and diluted as described in Example 33. Samples were analyzed by RapidFire-MS/MS as described in Example 31, Table 31.1. Glycosyltransferase variant polypeptides that produced rebaudioside A/rebaudioside M from stevioside/ rebaudioside D with in situ synthesized ADP-glucose at greater quantities than SEQ ID NO: 5290 were identified. The engineered polypeptides are listed in Table 65.1. Shake-flask scale cultures were grown, lysed, cleared, and lyophilized to powder as described in Example 31 for analysis of variants shown in Table 65.2 relative to SEQ ID NO: 5290.

TABLE 65.1

β1,3GT Round 13 Variants and RebA and RebM Levels

| SEQ ID NO: (nt/aa) | Amino Acid Differences (Relative to SEQ ID NO: 5290) | Increased RebA[a] | Increased RebM[a] |
|---|---|---|---|
| 5343/5344 | R308L | + | + |
| 5345/5346 | K53R/T54V/S55T/A153S/E201P | + | − |
| 5349/5350 | K53V/K171P/R308L/K392H | + | + |
| 5351/5352 | I91T/E201P/K439D/Y444H | + | + |
| 5353/5354 | R308L/F327L/K439D | ++ | − |
| 5355/5356 | E73S/W87M/E201P | − | ++ |
| 5357/5358 | K53V/T54V/R308L/K392H | + | − |
| 5359/5360 | K247A/Y249I/S252E/S254M/V320I/V428K | + | − |
| 5361/5362 | I25L/K247L/Y249I/S252E/G364S/V428K | + | − |
| 5363/5364 | V428K | + | + |
| 5365/5366 | S253G/V320I | + | + |
| 5367/5368 | Y249I/S252E/S253G/S254M | + | + |
| 5369/5370 | S252E/S253G/S254M | + | + |
| 5371/5372 | I25L/T61S/V428K | + | + |
| 5373/5374 | K190R | + | + |
| 5375/5376 | T61S/K208W/S252E/S254M/V428K | + | − |
| 5377/5378 | L107A/K247A/Y249I/S252E/S254M/G364S | + | + |
| 5379/5380 | L107A/K208N/V320I/G364S/V428K | ++ | + |
| 5381/5382 | L107A | ++ | + |
| 5383/5384 | K190R/K208N/K247L/S252E/V428K | + | + |
| 5385/5386 | I25L/K208E/K247L/S252E/S253G/G364S/V428K | + | + |
| 5387/5388 | V320I | + | + |
| 5389/5390 | V320I/V428K | ++ | + |
| 5391/5392 | I25L/T61S/K208N/S252E/S253G | + | − |
| 5393/5394 | L107A/K247A/S252E | + | − |
| 5395/5396 | T61S/L107T/K208N/S252E/S253G/S254M/G364S/V428K | ++ | + |
| 5397/5398 | I25L/L107T/K208E/V320I/V428K | + | + |
| 5399/5400 | V320I/G364S/V428K | + | + |

TABLE 65.1-continued

β1,3GT Round 13 Variants and RebA and RebM Levels

| SEQ ID NO: (nt/aa) | Amino Acid Differences (Relative to SEQ ID NO: 5290) | Increased RebA[a] | Increased RebM[a] |
|---|---|---|---|
| 5401/5402 | L107A/K247A/V428K | − | + |
| 5403/5404 | Y249I/S252E/S254M/V428K | + | − |
| 5405/5406 | V435Q | ++ | + |
| 5407/5408 | T172H | ++ | + |
| 5409/5410 | V435R | ++ | ++ |
| 5411/5412 | A427L | + | + |
| 5413/5414 | R296H | ND | + |
| 5415/5416 | K289S | ND | + |
| 5417/5418 | Q177P | ++ | + |
| 5419/5420 | G404T | ND | + |
| 5421/5422 | A438Q | ND | + |
| 5423/5424 | D431E | ND | + |
| 5425/5426 | V428E/D434N | ND | + |
| 5427/5428 | T54A | ND | + |
| 5429/5430 | K171T | ++ | + |
| 5431/5432 | W233Q/Q269R | ND | + |
| 5433/5434 | D431R | ND | + |
| 5435/5436 | E2L | + | + |
| 5437/5438 | D347K | ++ | + |
| 5439/5440 | Q424W | ND | + |
| 5441/5442 | S106T | ND | + |
| 5443/5444 | G169L | + | + |
| 5445/5446 | W233Q | ND | + |
| 5447/5448 | R417P | ++ | + |
| 5449/5450 | G169C | ND | + |
| 5451/5452 | V179A | + | + |
| 5453/5454 | S317R | ND | + |
| 5455/5456 | V428I | + | + |
| 5457/5458 | W233M | + | + |
| 5459/5460 | A251L | ND | + |
| 5461/5462 | V435K | ND | + |
| 5463/5464 | N408R | ND | + |
| 5465/5466 | W233C | + | + |
| 5467/5468 | D347H | + | + |
| 5469/5470 | K171S | + | + |
| 5471/5472 | R296Q | + | + |
| 5473/5474 | D300G | ND | + |
| 5475/5476 | G169V | ND | + |
| 5477/5478 | E2N | + | + |
| 5479/5480 | V435M | ND | + |
| 5481/5482 | G169Q | ND | + |
| 5483/5484 | W233K | ++ | + |
| 5485/5486 | E99P | ND | + |
| 5487/5488 | V428S | ND | + |
| 5489/5490 | V179S | ND | + |
| 5491/5492 | D347P | ++ | + |
| 5493/5494 | R296A | ND | + |
| 5495/5496 | Q424A | + | + |
| 5497/5498 | W233V | + | + |
| 5499/5500 | G169E | + | + |
| 5501/5502 | V435T | ND | + |
| 5503/5504 | K222A | ND | + |
| 5505/5506 | V428R | + | + |
| 5507/5508 | V428Q | ND | + |
| 5509/5510 | W233L | + | + |
| 5511/5512 | N159L | ND | + |
| 5513/5514 | V428F | ND | + |
| 5515/5516 | R38Q | − | + |
| 5517/5518 | F264A | ++ | + |
| 5519/5520 | D347R | ++ | + |
| 5521/5522 | R109S | ND | + |
| 5523/5524 | T172N | + | + |
| 5525/5526 | V435C | ND | + |
| 5527/5528 | K171V | + | + |
| 5529/5530 | A427R | ++ | + |
| 5531/5532 | F64S | + | ++ |
| 5533/5534 | E318T | − | + |
| 5535/5536 | W233G | + | + |

TABLE 65.1-continued

β1,3GT Round 13 Variants
and RebA and RebM Levels

| SEQ ID NO: (nt/aa) | Amino Acid Differences (Relative to SEQ ID NO: 5290) | Increased RebA[a] | Increased RebM[a] |
|---|---|---|---|
| 5537/5538 | E259T | ND | + |
| 5539/5540 | T7P | + | + |
| 5541/5542 | N68K | ND | + |

[a]Levels of increased production were determined relative to the reference polypeptide of SEQ ID NO: 5290, and defined as follows:
"−" = production less than that of the reference polypeptide;
"+" = production at least that of the reference polypeptide, but less than 1.3-fold; and
"++" = at least 1.3-fold increased production, as compared to the reference polypeptide.

SFP Characterization Assay and Analysis for Glucosyl Transfer from Sucrose to ADP and then from ADP-Glucose to (Stevioside and Rebaudioside D Shake flask powders (SFP) were reconstituted to a concentration of 20 g/L and diluted to 0.006-0.2 g/L SFP in 100 μL total reaction volumes of 50 mM potassium phosphate buffer, pH6, 4 mM stevioside (95% purity), rebaudioside D, or rebaudioside A (97% purity), 0.2 mM ADP (Sigma, >93% purity) co-substrate, 0.15 g/L SUS SFP SEQ ID NO: 1764, and 24 mM sucrose (cane sugar). The reactions were incubated at 50 and 55° C. in a Thermotron® titre-plate shaker with 300 RPM shaking for 1 hour. The reactions were solubilized by 20× dilution with water, quenched by 5× dilution in acetonitrile with 0.2% formic acid, cleared by centrifugation, and diluted 5× with water for analysis. Glycosylated products were detected in by SPE-QQQ as described in Example 31, Table 31.1.

TABLE 65.2

β1,3GT Round 13 Shake Flask Powder Variants
and RebA and RebM Levels

| SEQ ID NO: (nt/aa) | Amino Acid Differences (Relative to SEQ ID NO: 5290) | Increased RebA[a] | Increased RebM[a] |
|---|---|---|---|
| 5347/5348 | W87M | + | + |
| 5355/5356 | E73S/W87M/E201P | + | + |
| 5363/5364 | V428K | + | + |
| 5371/5372 | I25L/T61S/V428K | + | + |
| 5385/5386 | I25L/K208E/K247L/S252E/S253G/G364S/V428K | + | + |

[a]Levels of increased production were determined relative to the reference polypeptide of SEQ ID NO: 5290, and defined as follows:
"−" = production less than that of the reference polypeptide; and
"+" = production at least that of the reference polypepide, but less than 1.45-fold increased production, as compared to the reference polypeptide.

In these experiments, the five variants in Table 65.2 (i.e., SEQ ID NO: 5348, 5356, 5364, 5372, and 5386) produced rebaudioside A from stevioside and/or rebaudioside M from rebaudioside D with ADP-glucose at greater quantities than SEQ ID NO: 5290. SEQ ID NO: 5372 was selected for further directed evolution.

Example 66

Beta-1,3-ADP-Glycosyltransferase Variants of SEQ ID NO: 5372

In this Example, experiments for evolution and screening of β1,3-glycosyltransferase (β1,3GT) polypeptides derived from SEQ ID NO: 5372 for improved glucosylation of steviol glycosides using in situ synthesized ADP-glucose are described. Directed evolution of the GT encoded by SEQ ID NO: 5371 (i.e., SEQ ID NO: 5372) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide a fourteenth round ("Round 14") of 74 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared E. coli culture lysates expressing SEQ ID NO: 5371 variants. Pellets were lysed, and the lysate was cleared as described in Example 60, and then diluted 10× into potassium phosphate buffer, pH 6. Assays were conducted with 10 μL lysate in 100 μL reactions and with 10 mM stevioside (>95% purity) or rebaudioside D substrate, 0.2 mM ADP (Sigma, >93% purity) co-substrate, 0.15 g/L SUS SFP SEQ ID NO: 1764, and 40 mM sucrose (cane sugar). The following reaction conditions were used: 50 mM potassium phosphate buffer, pH 6, 60° C. in a Thermotron® titre-plate shaker with 300 RPM shaking for 2 h. Reactions were solubilized, quenched, and diluted to ~10 μM steviol glycosides as described in Example 60. Samples were analyzed by Rapid-Fire-MS/MS as described in Example 31, Table 31.1. Glycosyltransferase variant polypeptides that produced rebaudioside A/rebaudioside M from stevioside/rebaudioside D with in situ synthesized ADP-glucose at greater quantities than SEQ ID NO: 5372 were identified. The engineered polypeptides are listed in Table 66.1. Shake-flask scale cultures were grown, lysed, cleared, and lyophilized to powder as described in Example 1 for analysis of variants shown in Table 66.2 relative to SEQ ID NO: 5372.

TABLE 66.1

β1,3GT Round 14 Variants
and RebA and RebM Levels

| SEQ ID NO: (nt/aa) | Amino Acid Differences (Relative to SEQ ID NO: 5372) | Increased RebM[a] | Increased RebA[a] |
|---|---|---|---|
| 5543/5544 | W87M/Q177P/Y249I | +++ | ++ |
| 5545/5546 | I88R/K208E/Y249I/V320I | − | ++ |
| 5547/5548 | W87M/I88R/Q177P/D198E/Y249I | +++ | + |
| 5549/5550 | W87M/I88R | +++ | + |
| 5551/5552 | N159Q/D198I/K208E/V320I | +++ | +++ |
| 5553/5554 | W87M/D198E/A199K | ++ | ++ |
| 5555/5556 | W87M/D198E | +++ | ++ |
| 5557/5558 | I88R/V320I | + | +++ |
| 5559/5560 | W87M | +++ | ++ |

TABLE 66.1-continued

β1,3GT Round 14 Variants
and RebA and RebM Levels

| SEQ ID NO: (nt/aa) | Amino Acid Differences (Relative to SEQ ID NO: 5372) | Increased RebM[a] | Increased RebA[a] |
|---|---|---|---|
| 5561/5562 | W87M/I88R/E94K/N159Q/Q177P/K208E | +++ | ++ |
| 5563/5564 | W87M/K208E | +++ | ++ |
| 5565/5566 | I88R/Q177P/K208E | + | ++ |
| 5567/5568 | I88R/D198I | − | ++ |
| 5569/5570 | W87M/I88R/K208E | ++ | + |
| 5571/5572 | I88R | +++ | ++ |
| 5573/5574 | W87M/I88R/N159Q/D198E | +++ | + |
| 5575/5576 | W87M/K208E/V320I | ++ | + |
| 5577/5578 | Q177P/D198E | +++ | ++ |
| 5579/5580 | Q177P/K208E | ++ | + |
| 5581/5582 | N159Q/Q177P/K208E | +++ | ++ |
| 5583/5584 | W87M/N159Q/Q177P | +++ | ++ |
| 5585/5586 | I88R/Q177P/V320I | ++ | ++ |
| 5587/5588 | W87M/N159Q/V320I | ++ | + |
| 5589/5590 | N159Q/Q177P/D198E | +++ | ++ |
| 5591/5592 | W87M/V320I | +++ | + |
| 5593/5594 | I88R/A199K | − | ++ |
| 5595/5596 | I88R/A199K/K208E | − | ++ |
| 5597/5598 | W87M/D198E/K208E/V320I | +++ | ++ |
| 5599/5600 | I88R/K208E | − | ++ |
| 5601/5602 | I88R/Q177P | ++ | +++ |
| 5603/5604 | P272K | ND | + |
| 5605/5606 | D268G | ND | + |
| 5607/5608 | P158D | ND | + |
| 5609/5610 | E2H | ND | + |
| 5611/5612 | E2G | ND | + |
| 5613/5614 | E2P | ND | + |
| 5615/5616 | S374R | ND | + |
| 5617/5618 | S135A | ND | + |
| 5619/5620 | K171T | ND | + |
| 5621/5622 | S214L | ND | + |
| 5623/5624 | R173N | ND | + |
| 5625/5626 | L256P | ND | + |
| 5627/5628 | L437T | ND | + |
| 5629/5630 | L257Q | ND | + |
| 5631/5632 | L437I | ND | ++ |
| 5633/5634 | K222R | ND | + |
| 5635/5636 | D134S | ND | + |
| 5637/5638 | S374K | ND | ++ |
| 5639/5640 | N408D | ND | + |
| 5641/5642 | P158E | ND | + |
| 5643/5644 | E113S | ND | + |
| 5645/5646 | K392D | ND | + |
| 5647/5648 | Y453R | ND | + |
| 5649/5650 | K439A | ND | + |
| 5651/5652 | N195H | ND | + |
| 5653/5654 | K302R | ND | + |
| 5655/5656 | L257A | ND | + |
| 5657/5658 | R412H | ND | + |
| 5659/5660 | E330D | ND | + |
| 5661/5662 | R173P | ND | + |
| 5663/5664 | N399D | ND | + |
| 5665/5666 | A348C | ND | + |
| 5667/5668 | D134G | ND | + |
| 5669/5670 | K289T | ND | + |
| 5671/5672 | S253G | ND | + |
| 5673/5674 | D300G | ND | + |
| 5675/5676 | E73P | ND | + |
| 5677/5678 | F49A | ND | + |
| 5679/5680 | D268H | ND | ++ |
| 5681/5682 | D268A | ND | + |
| 5683/5684 | E445T | ND | + |
| 5685/5686 | E73T | ND | + |
| 5687/5688 | R411Q | ND | + |
| 5689/5690 | L437V | ND | ++ |

[a]Levels of increased production were determined relative to the reference polypeptide of SEQ ID NO: 5372, and defined as follows:
"−" = production less than 0.99-fold;
"+" = production at least 0.99-fold, but less than 1.25-fold;
"++" = at least 1.25-fold, but less than 1.6-fold; and
"+++" = at least 1.6-fold increased production, as compared to the reference polypeptide.
ND = not determined.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.006-0.2 g/L SFP in 100 μL total reaction volumes of 50 mM potassium phosphate buffer, pH6, 4 mM stevioside (95% purity), rebaudioside D, rebaudioside E, or rebaudioside A (97% purity), 0.2 mM ADP (Sigma, >93% purity) co-substrate, 0.15 g/L SUS SFP SEQ ID NO: 1764, and 24 mM sucrose (cane sugar). The reactions were incubated at 55 and 60° C. in a Thermotron® titre-plate shaker with 300 RPM shaking for 2 hours. The reactions were solubilized by 20× dilution with water, quenched by 5× dilution in acetonitrile with 0.2% formic acid, cleared by centrifugation, and diluted 5× with water for analysis. Glycosylated products were detected in by SPE-QQQ as described in Example 31, Table 31.1.

TABLE 66.2

β1,3GT Round 14 Shake Flask Powder Variants
and RebA, RebI, and RebM Levels

| SEQ ID NO: (nt/aa) | Amino Acid Differences (Relative to SEQ ID NO: 5372) | Increased RebA[a] | Increased RebI[a] | Increased RebE to rebM[a] | Increased RebD to rebM[a] |
|---|---|---|---|---|---|
| 5551/5552 | N159Q/D198I/K208E/V320I | + | + | ++ | + |
| 5561/5562 | W87M/I88R/E94K/N159Q/Q177P/K208E | + | + | +++ | ++ |
| 5573/5574 | W87M/I88R/N159Q/D198E | + | + | +++ | + |
| 5577/5578 | Q177P/D198E | + | + | ++ | + |
| 5581/5582 | N159Q/Q177P/K208E | + | + | +++ | + |
| 5589/5590 | N159Q/Q177P/D198E | + | + | +++ | + |

[a]Levels of increased production were determined relative to the reference polypeptide of SEQ ID NO: 5372, and defined as follows:
"−" = production less than that of the reference polypeptide;
"+" = production at least that of the reference polypeptide, but less than 2-fold;
"++" = at least 2-fold, but less than 4-fold; and
"+++" = at least 4-fold increased production, as compared to the reference polypeptide.

In these experiments, the six variants in Table 66.2 (i.e., SEQ ID NO: 5552, 5562, 6675, 5578, 5582, and 5590) produced more rebaudioside A from stevioside, less rebaudioside I from rebaudioside A, more rebaudioside M from rebaudioside E, and/or rebaudioside M from rebaudioside D with ADP-glucose at greater quantities than SEQ ID NO: 5372. SEQ ID NO: 5562 was the most improved for all four reactions, so it was selected for further directed evolution.

Example 67

Beta-1,3-ADP-Glycosyltransferase Variants of SEQ ID NO: 5562

In this Example, experiments for evolution and screening of β1,3-glycosyltransferase (β1,3GT) polypeptides derived from SEQ ID NO: 5562 for improved glucosylation of steviol glycosides using in situ synthesized ADP-glucose are described. Directed evolution of the GT encoded by SEQ ID NO: 5561 (i.e., SEQ ID NO: 5562) was carried out by constructing libraries of variant genes in which mutations associated with improved activity identified during the development of the present invention were recombined and in which certain structural features were subjected to saturation mutagenesis. These libraries were then plated, grown, and screened using the high-throughput (HTP) assay described below to provide a fifteenth round ("Round 15") of 62 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared *E. coli* culture lysates expressing SEQ ID NO: 5562 variants. Pellets were lysed, and lysate was cleared as described in Example 60 and then diluted 5× into 50 mM potassium phosphate buffer, pH 6. Assays were conducted with 10 µL lysate in 100 µL reactions and with 10 mM stevioside (>95% purity) or rebaudioside D substrate, 0.1-0.2 mM ADP (Sigma, >93% purity) co-substrate, 0.15 g/L SUS SFP SEQ ID NO: 1764, and 24-40 mM sucrose (cane sugar). The following reaction conditions were used: 50 mM potassium phosphate buffer, pH 6, 50 or 60° C. in a Thermotron® titre-plate shaker with 300 RPM shaking for 2 h. Reactions were solubilized, quenched, and diluted to ~10 µM steviol glycosides as described in Example 60. Samples were analyzed by RapidFire-MS/MS as described in Example 31, Table 31.1. Glycosyltransferase variant polypeptides that produced rebaudioside A/rebaudioside M from stevioside/ rebaudioside D with in situ synthesized ADP-glucose at greater quantities than SEQ ID NO: 5562 were identified. The engineered polypeptides from the combinatorial libraries are listed in Table 67.1, and those from the saturation mutagenesis libraries are listed in Table 67.2. Shake-flask scale cultures were grown, lysed, cleared, and lyophilized to powder as described in Example 31 for analysis of variants shown in Table 67.3 relative to SEQ ID NO: 5562.

TABLE 67.1

β1,3GT Round 15 Combinatorial Variants and RebA Levels

| SEQ ID NO: (nt/aa) | Amino Acid Differences (Relative to SEQ ID NO: 5562) | Increased RebA[a] |
|---|---|---|
| 5691/5692 | F64S/G169E/E201P/D347P/K392H | + |
| 5693/5694 | K171T/E201P/K392H/R417P | +++ |
| 5695/5696 | G169E/K171T/T172H/F264A/K392H/V435Q | + |
| 5697/5698 | G169E/T172H/E201P/F264A/D347G | ++ |
| 5699/5700 | I91T/E201P/F264A/D347G/K392H | ++ |
| 5701/5702 | G169E/T172H/E201P/D347G/K392H | ++ |
| 5703/5704 | G169E/K171T/E201P/F264A/K392H/V435Q | + |
| 5705/5706 | E201P/F264A/D347P/K392H/V435Q | ++ |
| 5707/5708 | G169E/T172H/E201P/F264A/D347K/K392H/V435R | ++ |
| 5709/5710 | E201P/F264A/D347K/K392H/R417P/V435R | + |
| 5711/5712 | G169E/T172H/E201P/R417P/V435R | + |
| 5713/5714 | F64S/T172H/F264A/D268V/D347P/K392H/R417P | + |
| 5715/5716 | E201P/F264A/D347K/R417P/V435R | ++ |
| 5717/5718 | I91T/K94E/K171T/T172H/E201P/F264A/D347G | + |
| 5719/5720 | K171T/T172H/E201P/F264A/K392H/R417P/V435R | +++ |
| 5721/5722 | K94E/E201P/F264A/D347G/V435Q | + |
| 5723/5724 | L107A/S252E/S317R | + |
| 5725/5726 | W233K/S252E/V320I | +++ |
| 5727/5728 | W233K/S252E/S317R/N408R | ++ |
| 5729/5730 | K190R/W233K/S252E/V320I/N408R | ++ |
| 5731/5732 | L107A/K190R/W233K/S252E/S317R/V320I | +++ |
| 5733/5734 | W233K/S252E/S317R/A427R | ++ |
| 5735/5736 | T7P/K190R/W233K/S252E/S317R/V320I/A427R/K428R | +++ |
| 5737/5738 | T7P/L107A/W233K/S252E/S253G | + |
| 5739/5740 | W233K/S252E/V320I/N408R/K428R | ++ |
| 5741/5742 | T7P/W233K/S252E/S253G/N408R | +++ |
| 5743/5744 | W233K/S252E/S253G/N408R/A427L | ++ |
| 5745/5746 | T7P/K190R/W233K/S252E/S253G/V320I/A427L | + |
| 5747/5748 | T7P/W233K/S252E/S253G/S317R/N408R/A427L | +++ |
| 5749/5750 | T7P/L107A/W233K/S252E/S317R/N408R | + |
| 5751/5752 | T7P/L107A/K190R/W233K/S252E/S253G/S317R/N408R/A427R | ++ |
| 5753/5754 | T7P/W233K/S252E/S317R/V320I/A427L | + |
| 5755/5756 | E2N/T7P/L107A/W233K/S252E/S253G/V320I | + |
| 5757/5758 | K190R/W233K/S252E/S253G/S317R/V320I/N408R/K428R | + |
| 5759/5760 | E2L/T7P/W233K/S252E/S253G/V320I/A427R/K428R | + |
| 5761/5762 | W233K/S252E/S253G/S317R/V320I/A427R/K428R | +++ |
| 5763/5764 | T7P/W233K/S252E/S317R/K428R | + |

TABLE 67.1-continued

β1,3GT Round 15 Combinatorial Variants and RebA Levels

| SEQ ID NO: (nt/aa) | Amino Acid Differences (Relative to SEQ ID NO: 5562) | Increased RebA[a] |
|---|---|---|
| 5765/5766 | E2N/W233K/S252E/S317R/V320I | + |
| 5767/5768 | L107A/W233K/S252E/S253G | ++ |
| 5769/5770 | T7P/L107A/W233K/S252E/S317R/V320I | + |
| 5771/5772 | T7P/K190R/W233K/S252E/N408R/A427R | + |
| 5773/5774 | K190R/W233K/S252E | ++ |
| 5775/5776 | L107A/K190R/W233K/S252E | + |
| 5777/5778 | K190R/W233K/S252E/S317R/N408R | +++ |
| 5779/5780 | E2N/T7P/L107A/VV233K/S252E/S253G/V320I/N408R/K428R | + |
| 5781/5782 | A348S/S374R/V435R | + |
| 5783/5784 | S374R | + |

[a]Levels of increased production were determined relative to the reference polypeptide of SEQ ID NO: 5562, and defined as follows:
"+" = production at least 1.59-fold, but less than 2.8-fold;
"++" = at least 2.8-fold, but less than 3.1-fold; and
"+++" = at least 3.1-fold increased production, as compared to the reference polypeptide.

TABLE 67.2

β1,3GT Round 15 Saturation Mutagenesis Variants and RebA and RebM Levels

| SEQ ID NO: (nt/aa) | Amino Acid Differences (Relative to SEQ ID NO: 5562) | Increased RebA, 50° C.[a] | Increased RebA, 60° C.[a] | Increased RebM, 60° C.[a] |
|---|---|---|---|---|
| 5785/5786 | L56A | − | + | ++ |
| 5787/5788 | S55V | − | − | + |
| 5789/5790 | R308Q | − | ++ | +++ |
| 5791/5792 | K336Q | + | − | − |
| 5793/5794 | G364A | + | +++ | +++ |
| 5795/5796 | E342W | + | + | + |
| 5797/5798 | T282S | ++ | +++ | +++ |
| 5799/5800 | R308L | + | +++ | ++ |
| 5801/5802 | G364S | +++ | +++ | +++ |
| 5803/5804 | E407C | + | + | +++ |
| 5805/5806 | L391C | + | ++ | +++ |
| 5807/5808 | E407V | ++ | ++ | +++ |
| 5809/5810 | V14I | ++ | ++ | ++ |
| 5811/5812 | S255L | + | + | + |
| 5813/5814 | M422Q | − | + | + |

[a]Levels of increased production were determined relative to the reference polypeptide of SEQ ID NO: 5562, and defined as follows:
"−" = production less than that of the reference polypeptide;
"+" = production at least that of the reference polypeptide, but less than 1.25-fold;
"++" = at least 1.25-fold, but less than 1.4-fold; and
"+++" = at least 1.4-fold increased production, as compared to the reference polypeptide.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.006-0.2 g/L SFP in 100 μL total reaction volumes of 50 mM potassium phosphate buffer, pH6, 10 mM stevioside (95% purity) or rebaudioside D, 0.2 mM ADP (Sigma, >93% purity) co-substrate, 0.15 g/L SUS SFP SEQ ID NO: 1764, and 24 mM sucrose (cane sugar). The reactions were incubated at 50 and 60° C. in a Thermotron® titre-plate shaker with 300 RPM shaking for 2 hours. The reactions were solubilized by 20× dilution with water, quenched by 5× dilution in acetonitrile with 0.2% formic acid, cleared by centrifugation, and diluted 5× with water for analysis. Glycosylated products were detected in by SPE-QQQ as described in Example 31, Table 31.1.

TABLE 67.3

β1,3GT Round 15 Shake Flask Powder Variants and RebA and RebM Levels

| SEQ ID NO: (nt/aa) | Amino Acid Differences (Relative to SEQ ID NO: 5562) | Increased RebA, 50° C.[a] | Increased RebA, 60° C.[a] | Increased RebM, 60° C.[a] |
|---|---|---|---|---|
| 5693/5694 | K171T/E201P/K392H/R417P | + | + | ++ |
| 5707/5708 | G169E/T172H/E201P/F264A/D347K/K392H/V435R | + | ++ | +++ |
| 5713/5714 | F64S/T172H/F264A/D268V/D347P/K392H/R417P | + | + | +++ |
| 5719/5720 | K171T/T172H/E201P/F264A/K392H/R417P/V435R | + | ++ | ++ |
| 5731/5732 | L107A/K190R/W233K/S252E/S317R/V320I | − | + | +++ |
| 5735/5736 | T7P/K190R/W233K/S252E/S317R/V320I/A427R/K428R | − | ++ | ++ |

TABLE 67.3-continued

β1,3GT Round 15 Shake Flask Powder Variants
and RebA and RebM Levels

| SEQ ID NO: (nt/aa) | Amino Acid Differences (Relative to SEQ ID NO: 5562) | Increased RebA, 50° C.[a] | Increased RebA, 60° C.[a] | Increased RebM, 60° C.[a] |
|---|---|---|---|---|
| 5761/5762 | W233K/S252E/S253G/S317R/V320I/A427R/K428R | − | + | ++ |
| 5777/5778 | K190R/W233K/S252E/S317R/N408R | − | + | +++ |

[a]Levels of increased production were determined relative to the reference polypeptide of SEQ ID NO: 5562, at 0.025 g/L shake flask powder and defined as follows:
"−" = production less than that of the reference polypeptide;
"+" = production at least that of the reference polypeptide, but less than 2-fold;
"++" = at least 2-fold, but less than 2.4-fold; and
"+++" = at least 2.4-fold increased production, as compared to the reference polypeptide.

In these experiments, the eight variants in Table 67.3 produced more rebaudioside A from stevioside and/or more rebaudioside M from rebaudioside D at 50° C. and/or 60° C. than SEQ ID NO: 5562. SEQ ID NO: 5708 was the most improved for converting stevioside to rebaudioside A for both temperatures and also improved for converting rebaudioside D to rebaudioside M at 60° C., so it was selected for further directed evolution.

Example 68

Beta-1,3-ADP-Glycosyltransferase Variants of SEQ ID NO: 5708

In this Example, experiments for evolution and screening of β1,3-glycosyltransferase (β1,3GT) polypeptides derived from SEQ ID NO: 5708 for improved glucosylation of steviol glycosides using in situ synthesized ADP-glucose are described. Directed evolution of the GT encoded by SEQ ID NO: 5707 (i.e., SEQ ID NO: 5708) was carried out by constructing libraries of variant genes in which mutations associated with improved production identified during the development of the present invention were recombined. These libraries were then plated, grown, and screened using the high-throughput (HTP) assay described below to provide a sixteenth round ("Round 16") of 100 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared *E. coli* culture lysates expressing SEQ ID NO: 5708 variants. Pellets were lysed, and lysate was cleared as described in Example 60, and then diluted 20× into 50 mM potassium phosphate buffer, pH6. Assays were conducted with 10 μL lysate in 100 μL reactions and with 10 mM stevioside (>95% purity), rebaudioside D, rebaudioside A (>97% purity), or rebaudioside E substrate, 0.2 mM ADP (Sigma, >93% purity) co-substrate, 0.15 g/L SUS SFP SEQ ID NO: 1764, and 24m sucrose (cane sugar). The following reaction conditions were used: 50 mM potassium phosphate buffer, pH 6, 60° C. in a Thermotron® titre-plate shaker with 300 RPM shaking for 3h. Reactions were solubilized, quenched, and diluted to ~10 μM steviol glycosides as described in Example 60. Samples were analyzed by RapidFire-MS/MS as described in Example 31, Table 31.1. Glycosyltransferase variant polypeptides that produced rebaudioside A rebaudioside M from stevioside/rebaudioside D with in situ synthesized ADP-glucose at greater quantities than SEQ ID NO: 5708 were identified. The engineered polypeptides are listed in Table 68.1. Shake-flask scale cultures were grown, lysed, cleared, and lyophilized to powder as described in Example 31 for analysis of variants shown in Table 68.2 relative to SEQ ID NO: 5708.

TABLE 68.1

β1,3GT Round 16 Combinatorial Variants
and RebA Levels

| SEQ ID NO: (nt/aa) | Amino Acid Differences (Relative to SEQ ID NO: 5708) | Increased RebA[a] |
|---|---|---|
| 5815/5816 | R173N/K190R/S252E/L257A/K347G/A427R/L437I | +++ |
| 5817/5818 | R173N | + |
| 5819/5820 | W233K/S252E/L437V | +++ |
| 5821/5822 | R173N/K190R/L257A/A427R/L437I | ++ |
| 5823/5824 | K347G/R411Q/L437I | ++ |
| 5825/5826 | W233K/S252E/E285Q/L437V | ++ |
| 5827/5828 | R173N/S252E | +++ |
| 5829/5830 | E285Q/K347G/L437V | + |
| 5831/5832 | R173N/S252E/D268H/L437V | ++ |
| 5833/5834 | L257A/K347G/R411Q/L437V | + |
| 5835/5836 | S252E/L257A/K347G/L437V | ++ |
| 5837/5838 | R173N/S252E/K347G/R411Q | ++ |
| 5839/5840 | W233K/S252E | +++ |
| 5841/5842 | R173N/W233K/S252E/L257A/A427R | + |
| 5843/5844 | W233K/S252E/L257A/A427R/L437V | + |
| 5845/5846 | W233K/S252E/R411Q/L437V | +++ |
| 5847/5848 | R173N/L257A/S374K/L437V | + |
| 5849/5850 | K190R/S252E/L257A/R411Q/L437I | + |
| 5851/5852 | R173N/K190R/L257A/S374K/L437V | + |
| 5853/5854 | W233K/S374K/L437I | + |
| 5855/5856 | K347G/A427R/L437V | ++ |
| 5857/5858 | K190R/W233K/S252E/L257A/K347G/R411Q/L437I | ++ |
| 5859/5860 | W233K/S252E/L257A/K347G | +++ |
| 5861/5862 | W233K/S252E/L257A/K347G/R411Q/L437I | +++ |
| 5863/5864 | K190R/S252E/L257A/E285Q/A427R | ++ |
| 5865/5866 | R173N/K190R/W233K/S252E/A427R/L437V | + |
| 5867/5868 | S374K/R411Q/L437V | + |
| 5869/5870 | R173N/W233K/L437I | + |
| 5871/5872 | R173N/A427R/L437I | + |
| 5873/5874 | S374K/R411Q/L437I | + |
| 5875/5876 | K190R/S252E | ++ |
| 5877/5878 | S252E/L257A | ++ |
| 5879/5880 | W233K/S374K | + |
| 5881/5882 | R411Q/L437V | + |
| 5883/5884 | S374K | + |
| 5885/5886 | K190R/S374K/A427R/L437V | + |
| 5887/5888 | L437I | ++ |
| 5889/5890 | R173N/S374K/L437I | ++ |
| 5891/5892 | K190R/S252E/L257A/A427R | + |
| 5893/5894 | W233K/S252E/L257A | ++ |
| 5895/5896 | W233K/S252E/E285Q | + |
| 5897/5898 | L163A/L257Q/K302R/G364S | ++ |
| 5899/5900 | K302R/G364S | ++ |
| 5901/5902 | E2P/K4T/P158D/L163A/G364S/S449R | +++ |
| 5903/5904 | E2P/P158D/L163R | + |

TABLE 68.1-continued

β1,3GT Round 16 Combinatorial Variants and RebA Levels

| SEQ ID NO: (nt/aa) | Amino Acid Differences (Relative to SEQ ID NO: 5708) | Increased RebA[a] |
|---|---|---|
| 5905/5906 | E2P/L163R/G364S/Y453R | + |
| 5907/5908 | E2P/K4T/L163A/L257Q | ++ |
| 5909/5910 | G364S/N399D | ++ |
| 5911/5912 | E2P/K4T/L163A/G364S/Y453R | ++ |
| 5913/5914 | E2P/K4T/L163A/E330D/S449R | ++ |
| 5915/5916 | K4T/E113S/P158D/K302R/E330D/G364S | + |
| 5917/5918 | E2P/E113S/S449R | + |
| 5919/5920 | E2P/K4T/K302R | + |
| 5921/5922 | L163R/K302R/E330D/G364S/S449R | + |
| 5923/5924 | E330D/G364S | + |
| 5925/5926 | E2P/K4T/E113S/P158D/L163A/E330D/S449R | +++ |
| 5927/5928 | E2P/P158D/L163A/G364S/N399D | +++ |
| 5929/5930 | E2P/K4T/L163R/L257Q/E330D/N399D/S449R | ++ |
| 5931/5932 | E2P/E113S/L163R/S449R | + |
| 5933/5934 | L163A/G364S | ++ |
| 5935/5936 | P158D/L163A/G364S | ++ |
| 5937/5938 | E2P/K4T/P158D/E330D | +++ |
| 5939/5940 | E2P/E113S | + |
| 5941/5942 | E2P/K4T/L163R/K222R/K302R/E330D/G364S/S449R | + |
| 5943/5944 | E113S/P158D/L163A/G364S/N399D | + |
| 5945/5946 | K4T/E113S/L163A/G364S/N399D | ++ |
| 5947/5948 | E2P/K4T/E113S/P158D/L163R/K302R/G364S/N399D/S449R | + |
| 5949/5950 | E2P/K4T/L163A/G364S | +++ |
| 5951/5952 | K4T/P158D/L163A/G364S/N399D | ++ |
| 5953/5954 | E2P/E113S/L163A | + |
| 5955/5956 | E2P/K4T/P158D/K222R/L257Q/K302R/E330D | ++ |
| 5957/5958 | K4T/E113S/P158D/L163A/E330D/G364S/N399D | ++ |
| 5959/5960 | E2P/K4T/E113S/L163R/S449R | + |
| 5961/5962 | E113S/P158D/L163R/G364S/N399D | + |
| 5963/5964 | P158D/L163R/K302R/E330D/G364S/N399D | + |
| 5965/5966 | K4T/G364S/S449R | ++ |
| 5967/5968 | E2P/G364S/S449R | +++ |
| 5969/5970 | E2P/E113S/E330D/N399D | + |
| 5971/5972 | P158D/L163A/L257Q/E330D/G364S/S449R | + |
| 5973/5974 | D134S | + |
| 5975/5976 | L107A/N195H/R417P/K439P | +++ |
| 5977/5978 | N195H/P272K/V320I/K439P | + |
| 5979/5980 | D134S/S135A/N195H/D268A/S317R | + |
| 5981/5982 | N195H/S317R/V320I | + |
| 5983/5984 | L107A/N195H/P272K | ++ |
| 5985/5986 | L107A/S374T/R417P/K439P | + |
| 5987/5988 | L107A/D134S/S135A/N195H/R412H/R417P | + |
| 5989/5990 | L107A/N195H/D268A/P322L/K439P | +++ |
| 5991/5992 | N408D/R417P | + |
| 5993/5994 | D268A/R417P | + |
| 5995/5996 | M87W/W266L | ++ |
| 5997/5998 | M87W/D198E | + |
| 5999/6000 | D198E/L292P | +++ |
| 6001/6002 | M87W/H95L/D198E | + |
| 6003/6004 | D198I | +++ |
| 6005/6006 | M87W/P322S | +++ |
| 6007/6008 | D198I/P244L | ++ |
| 6009/6010 | M87W | + |
| 6011/6012 | D198E | + |
| 6013/6014 | M87W/D198I | +++ |

[a]Levels of increased production were determined relative to the reference polypeptide of SEQ ID NO: 5708, and defined as follows:
"+" = production at least 1.05-fold, but less than 1.42-fold;
"++" = at least 1.42-fold, but less than 1.6-fold; and
"+++" = at least 1.6-fold increased production, as compared to the reference polypeptide.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.006-0.2 g/L SFP in 100 μL total reaction volumes of 50 mM potassium phosphate buffer, pH6, 10 mM stevioside (>95% purity), rebaudioside D, rebaudioside E, or rebaudioside A (>97% purity), 0.2 mM ADP (Sigma, >93% purity) co-substrate, 0.15 g/L SUS SFP SEQ ID NO: 1764, and 24 mM sucrose (cane sugar). The reactions were incubated at 50° C. and 60° C. in a Thermotron® titre-plate shaker with 300 RPM shaking for 3 hours. The reactions were solubilized by 20× dilution with water, quenched by 5× dilution in acetonitrile with 0.2% formic acid, cleared by centrifugation, and diluted 10× with water for analysis. Glycosylated products were detected in by SPE-QQQ as described in Example 31, Table 31.1.

TABLE 68.2

β1,3GT Round 16 Shake Flask Powder Variants and RebA and RebM Levels

| SEQ ID NO: (nt/aa) | Amino Acid Differences (Relative to SEQ ID NO: 5708) | Increased RebA, 50° C.[a] | Increased RebA, 60° C.[a] | Increased RebM, 60° C.[a] | Increased RebM from E, 60° C.[a] |
|---|---|---|---|---|---|
| 5815/5816 | R173N/K190R/S252E/L257A/K347G/A427R/L437I | − | +++ | − | − |
| 5839/5840 | W233K/S252E | − | ++ | − | + |
| 5845/5846 | W233K/S252E/R411Q/L437V | − | + | − | − |
| 5901/5902 | E2P/K4T/P158D/L163A/G364S/S449R | ++ | + | + | + |
| 5927/5928 | E2P/P158D/L163A/G364S/N399D | ++ | + | + | ++ |
| 5949/5950 | E2P/K4T/L163A/G364S | ++ | + | + | ND |
| 5975/5976 | L107A/N195H/R417P/K439P | ++ | ++ | + | ND |
| 5983/5984 | L107A/N195H/P272K | ++ | + | − | ND |
| 5989/5990 | L107A/N195H/D268A/P322L/K439P | +++ | + | − | ND |

TABLE 68.2-continued

β1,3GT Round 16 Shake Flask Powder Variants and RebA and RebM Levels

| SEQ ID NO: (nt/aa) | Amino Acid Differences (Relative to SEQ ID NO: 5708) | Increased RebA, 50° C.[a] | Increased RebA, 60° C.[a] | Increased RebM, 60° C.[a] | Increased RebM from E, 60° C.[a] |
|---|---|---|---|---|---|
| 5997/5998 | M87W/D198E | +++ | +++ | − | ND |
| 6009/6010 | M87W | +++ | +++ | − | ND |
| 6011/6012 | D198E | ++ | + | + | ND |

[a] Levels of increased production were determined relative to the reference polypeptide of SEQ ID NO: 5708, at 0.025 g/L shake flask powder and defined as follows:
"−" = production less than that of the reference polypeptide;
"+" = production at least that of the reference polypeptide, but less than 1.26-fold;
"++" = at least 1.26-fold, but less than 1.5-fold; and
"+++" = at least 1.5-fold increased production, as compared to the reference polypeptide.
ND = not determined.

In these experiments, the thirteen variants in Table 68.2 produced more rebaudioside A from stevioside and/or more rebaudioside M from rebaudioside D at 50° C. and/or 60° C. than SEQ ID NO: 5708. SEQ ID NO: 5976 had the greatest improvement for conversion of stevioside to rebaudioside A without a loss in rebaudioside D to rebaudioside M activity for both temperatures, so this variant was selected for further directed evolution.

Example 69

Beta-1,3-ADP-Glycosyltransferase Variants of SEQ ID NO: 5976

In this Example, experiments for evolution and screening of β1,3-glycosyltransferase (β1,3GT) polypeptides derived from SEQ ID NO: 5976 for improved glucosylation of steviol glycosides using in situ synthesized ADP-glucose are described. Directed evolution of the GT encoded by SEQ ID NO: 5975 (i.e., SEQ ID NO: 5976) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide a seventeenth round ("Round 17") of 123 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared E. coli culture lysates expressing SEQ ID NO: 5976 variants. Pellets were lysed, and the lysate was cleared as described in Example 60 and then diluted 20× into buffer. In order to thermally challenge the lysates, they were pre-incubated in a thermocycler for 15 minutes at 65.5° C. Assays were conducted with 10 μL pre-incubated lysate in 100 μL reactions and with 10 mM stevioside (>95% purity) or rebaudioside D substrate, 0.2 mM ADP (Sigma, >93% purity) co-substrate, 0.1 g/L SUS SFP SEQ ID NO: 1804, and 24 mM sucrose (cane sugar). The following reaction conditions were used: 50 mM potassium phosphate buffer, pH 6, 60° C. in a Thermotron® titre-plate shaker with 300 RPM shaking for 4 h. Reactions were solubilized by 20× dilution with water, quenched by 5× dilution in acetonitrile with 0.2% formic acid, and diluted 10× with water for analysis. Samples were analyzed by RapidFire-MS/MS as described in Example 31, Table 31.1. Glycosyltransferase variant polypeptides that produced rebaudioside A/rebaudioside M from stevioside/rebaudioside D with in situ synthesized ADP-glucose at greater quantities than SEQ ID NO: 5976 were identified. The engineered polypeptides are listed in Table 69.1. Shake-flask scale cultures were grown, lysed, cleared, and lyophilized to powder as described in Example 31 for analysis of variants shown in Table 69.2 relative to SEQ ID NO: 5976.

TABLE 69.1

β1,3GT Round 17 Variants and RebA and RebM Levels

| SEQ ID NO: (nt/aa) | Amino Acid Differences (Relative to SEQ ID NO: 5976) | Increased RebA[a] | Increased RebM[a] |
|---|---|---|---|
| 6015/6016 | K4T/D198E/N399D/E407V | + | + |
| 6017/6018 | E2P/V14I/T282S/R308L | ++ | +++ |
| 6019/6020 | T282S/R308L/E342W/G364A/S449R | +++ | +++ |
| 6021/6022 | E2P/V14I/R308L/G364A | +++ | +++ |
| 6023/6024 | E2P/K4T/T282S/E342W/G364A/E407V | +++ | +++ |
| 6025/6026 | K4T/L163A/T282S/R308L/E407V | ++ | ++ |
| 6027/6028 | E2P/T282S/N399D | + | ++ |
| 6029/6030 | P158D/T282S/E407V | ++ | + |
| 6031/6032 | E2P/V14I/P158D/D198E/E407V/S449R | +++ | +++ |
| 6033/6034 | E2P/V14I/R308L | ++ | ++ |
| 6035/6036 | V14I/P158D/L163A/D198E/G364A | ++ | +++ |
| 6037/6038 | E2P/K4T/V14I/T282S/R308L/G364A | +++ | +++ |
| 6039/6040 | D198E/T282S/E407V | +++ | +++ |
| 6041/6042 | E2P/V14I/L163A/R308L/G364A | +++ | +++ |
| 6043/6044 | E2P/R308L/G364A/N399D | +++ | ++ |

TABLE 69.1-continued

β1,3GT Round 17 Variants
and RebA and RebM Levels

| SEQ ID NO: (nt/aa) | Amino Acid Differences (Relative to SEQ ID NO: 5976) | Increased RebA[a] | Increased RebM[a] |
|---|---|---|---|
| 6045/6046 | E2P/V14I/T282S/N399D | ++ | ++ |
| 6047/6048 | T282S/R308L/S449R | + | + |
| 6049/6050 | K4T/V14I/T282S/R308L/G364A/E407V/S449R | +++ | +++ |
| 6051/6052 | E2P/K4T/V14I/D198E/R308L/E407V | +++ | ++ |
| 6053/6054 | P158D/G364A/N399D/E407V/S449R | ++ | + |
| 6055/6056 | V14I/T282S/E342W/G364A/L391C | ++ | ++ |
| 6057/6058 | E2P/T282S/R308L/E342W/E407V | ++ | +++ |
| 6059/6060 | E2P/K4T/P158D/L163A/G364A/N399D/E407V | ++ | ++ |
| 6061/6062 | L163A/T282S/N399D/E407V | ++ | + |
| 6063/6064 | V14I/P158D/D198E/T282S/E342W/G364A/S449R | +++ | ++ |
| 6065/6066 | P158D/T282S/E407V/S449R | ++ | ++ |
| 6067/6068 | E2P/K4T/V14I/P158D/T282S/E407V | +++ | +++ |
| 6069/6070 | V14I/L163A/D198E/T282S/E342W/G364A/S449R | +++ | ++ |
| 6071/6072 | E2P/L163A/T282S | ++ | + |
| 6073/6074 | E2P/T282S | ++ | + |
| 6075/6076 | V14I/P158D/L163A/T282S/G364A | +++ | + |
| 6077/6078 | E2P/K4T/V14I/T282S/R308L/E407V | ++ | + |
| 6079/6080 | K4T/V14I/L163A/T282S/R308L/E342W/E407V/S449R | ++ | + |
| 6081/6082 | E2P/L163A/T282S/R308L/G364A | +++ | ++ |
| 6083/6084 | E2P/K4T/L163A/G364A/N399D/S449R | ++ | +++ |
| 6085/6086 | L163A/D198E/T282S/E342W | ++ | ++ |
| 6087/6088 | V14I/P158D/G364A | ++ | + |
| 6089/6090 | K4T/V14I/D198E/R308L/G364A | +++ | + |
| 6091/6092 | E2P/D198E/T282S/R308L/E342W | +++ | +++ |
| 6093/6094 | K4T/V14I/P158D/T282S/G364A/L391C/E407V | +++ | ++ |
| 6095/6096 | K4T/V14I/G364A/L391C | + | ++ |
| 6097/6098 | K4T/V14I/L163A/T282S | + | + |
| 6099/6100 | E2P/K4T/V14I/L163A/T282S/N399D | ++ | ++ |
| 6101/6102 | V14I/E407V | ++ | ++ |
| 6103/6104 | E2P/K4T/L163A/D198E/T282S/R308L/E342W | ++ | ++ |
| 6105/6106 | L163A/T282S/E407V/S449R | +++ | +++ |
| 6107/6108 | E2P/P158D/L163A/E407V/S449R | + | ++ |
| 6109/6110 | E2P/K4T/D198E/G364A/L391C/S449R | ++ | +++ |
| 6111/6112 | V14I/T282S | ++ | ++ |
| 6113/6114 | V14I/L163A/T282S/R308L | + | ++ |
| 6115/6116 | E2P/R308L | ++ | + |
| 6117/6118 | E2P/K4T/L163A/T282S/E342W/G364A | +++ | +++ |
| 6119/6120 | D198E/R308L | ++ | + |
| 6121/6122 | E2P/T282S/R308L/L391C/E407V | + | + |
| 6123/6124 | K4T/V14I/T282S | + | + |
| 6125/6126 | E2P/K4T/D198E/T282S/S449R | +++ | +++ |
| 6127/6128 | E2P/K4T/V14I/T282S/G364A | +++ | +++ |
| 6129/6130 | E2P/V14I/T282S | ++ | + |
| 6131/6132 | E2P/T282S/N399D/E407V | +++ | ++ |
| 6133/6134 | K4T/T282S/G364A/E407V | +++ | ++ |
| 6135/6136 | K4T/V14I/P158D/L163A/D198E/T282S/E407V | +++ | ++ |
| 6137/6138 | E2P/K4T/P158D/D198E/T282S/G364A/E407V | +++ | +++ |
| 6139/6140 | E2P/V14I/L163A/G364A/E407V | +++ | +++ |
| 6141/6142 | V14I/T282S/N399D/E407V/S449R | ++ | ++ |
| 6143/6144 | K4T/V14I/T282S/E342W/N399D/E407V | + | + |
| 6145/6146 | E2P/V14I/T282S/R308L/G364A | +++ | ++ |
| 6147/6148 | E2P/K4T/V14I/P158D/T282S/G364A/S449R | +++ | ++ |
| 6149/6150 | E2P/D198E/T282S/N399D | +++ | ++ |
| 6151/6152 | P158D/G364A/S449R | ++ | + |
| 6153/6154 | E2P/K4T/V14I/L163A/D198E | ++ | + |
| 6155/6156 | K4T/T282S/E342W/G364A/E407V | +++ | + |
| 6157/6158 | L163A/T282S/R308L/G364A/N399D | +++ | ++ |
| 6159/6160 | D198E/T282S/R308L/E342W | ++ | + |
| 6161/6162 | V14I/T282S/G364A | +++ | ++ |
| 6163/6164 | K4T/G364A | ++ | + |
| 6165/6166 | V14I/T282S/R308L | + | + |
| 6167/6168 | V14I/T282S/G364A/L391C/E407V/S449R | +++ | ++ |
| 6169/6170 | K4T/P158D/T282S/G364A/N399D | ++ | + |
| 6171/6172 | L75G | + | + |
| 6173/6174 | P139S | + | + |
| 6175/6176 | L401F/E402L | + | ++ |
| 6177/6178 | P131V | ND | + |
| 6179/6180 | L138V | ND | + |
| 6181/6182 | P90S | ND | + |
| 6183/6184 | S254Q | + | + |
| 6185/6186 | P139R | + | + |
| 6187/6188 | M108H | ND | + |
| 6189/6190 | S106Y | + | + |
| 6191/6192 | R12S | ND | + |

TABLE 69.1-continued

β1,3GT Round 17 Variants and RebA and RebM Levels

| SEQ ID NO: (nt/aa) | Amino Acid Differences (Relative to SEQ ID NO: 5976) | Increased RebA[a] | Increased RebM[a] |
|---|---|---|---|
| 6193/6194 | P90T | ND | + |
| 6195/6196 | D416S | + | + |
| 6197/6198 | P139A | + | + |
| 6199/6200 | A427K | ND | + |
| 6201/6202 | I44V | ND | + |
| 6203/6204 | V365I | + | + |
| 6205/6206 | S37R | + | + |
| 6207/6208 | K247C | + | ++ |
| 6209/6210 | D258N | ND | + |
| 6211/6212 | E115R | + | + |
| 6213/6214 | Q71L/R331K | + | + |
| 6215/6216 | L75M | + | + |
| 6217/6218 | D416L | + | + |
| 6219/6220 | D114P | + | + |
| 6221/6222 | D389S | ND | + |
| 6223/6224 | S456R | ND | + |
| 6225/6226 | S456* | − | + |
| 6227/6228 | S156C | + | + |
| 6229/6230 | P70K | + | − |
| 6231/6232 | D389A | + | ++ |
| 6233/6234 | H248W | + | +++ |
| 6235/6236 | A427R | + | ++ |
| 6237/6238 | L429W | + | + |
| 6239/6240 | K247L | + | + |
| 6241/6242 | A433L | + | +++ |
| 6243/6244 | E162A | + | + |
| 6245/6246 | H248L | + | +++ |
| 6247/6248 | K432L | + | ++ |
| 6249/6250 | H248C | + | ++ |
| 6251/6252 | L174P | + | + |
| 6253/6254 | P112N | ND | + |
| 6255/6256 | D389E | + | ++ |
| 6257/6258 | P90Q | − | + |
| 6259/6260 | W74H | + | + |

[a]Levels of increased production were determined relative to the reference polypeptide of SEQ ID NO: 5976, and defined as follows:
"+" = production at least that of the reference polypeptide, but less than 2-fold;
"++" = at least 2-fold, but less than 2.75-fold; and
"+++" = at least 2.75-fold increased production, as compared to the reference polypeptide.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.006-0.2 g/L SFP in 100 μL total reaction volumes of 50 mM potassium phosphate buffer, pH6, 10 mM stevioside (>95% purity) or rebaudioside D, 0.2 mM ADP (Sigma, >93% purity) co-substrate, 0.1 g/L SUS SFP SEQ ID NO: 1804, and 24 mM sucrose (cane sugar). The reactions were incubated at 55° C. with no pre-incubation or at 60° C. following 15 minute pre-incubation at 65.5° C. in a Thermotron® titre-plate shaker with 300 RPM shaking for 4 hours. The reactions were solubilized by 20× dilution with water, quenched by 5× dilution in acetonitrile with 0.2% formic acid, cleared by centrifugation, and diluted 10× with water for analysis. Glycosylated products were detected in by SPE-QQQ as described in Example 31, Table 31.1.

TABLE 69.2

β1, 3GT Round 17 Shake Flask Powder Variants and RebA and RebM Levels

| SEQ ID NO: (nt/aa) | Amino Acid Differences (Relative to SEQ ID NO: 5976) | Increased RebA, 55° C[a] | Increased RebA, 60° C[a] | Increased RebM, 60° C[a] |
|---|---|---|---|---|
| 6147/6148 | E2P/K4T/V14I/P158D/T282S/G364A/S449R | + | ++ | ++ |
| 6037/6038 | E2P/K4T/V14I/T282S/R308L/G364A | + | +++ | ++ |
| 6137/6138 | E2P/K4T/P158D/D198E/T282S/G364A/E407V | + | +++ | ++ |
| 6091/6092 | E2P/D198E/T282S/R308L/E342W | + | + | + |
| 6067/6068 | E2P/K4T/V14I/P158D/T282S/E407V | + | ++ | ++ |
| 6049/6050 | K4T/V14I/T282S/R308L/G364A/E407V/S449R | + | +++ | ++ |

TABLE 69.2-continued

β1, 3GT Round 17 Shake Flask Powder Variants and RebA and RebM Levels

| SEQ ID NO: (nt/aa) | Amino Acid Differences (Relative to SEQ ID NO: 5976) | Increased RebA, 55° C[a] | Increased RebA, 60° C[a] | Increased RebM, 60° C[a] |
|---|---|---|---|---|
| 6023/6024 | E2P/K4T/T282S/E342W/G364A/E407V | + | +++ | ++ |
| 6105/6106 | L163A/T282S/E407V/S449R | + | ++ | ++ |

[a]Levels of increased production were determined relative to the reference polypeptide of SEQ ID NO: 5976, at 0.025 g/L shake flask powder and defined as follows: "+" = production at least 1.3-fold, but less than 2.4-fold; "++" = at least 2.4-fold, but less than 4-fold; and "+++" = at least 4-fold increased production, as compared to the reference polypeptide.

In these experiments, the eight variants in Table 69.2 produced more rebaudioside A from stevioside and/or more rebaudioside M from rebaudioside D at 55° C. and/or 60° C. than SEQ ID NO: 5976. SEQ ID NO: 6138 had the greatest improvement for conversion of stevioside to rebaudioside A under the conditions with pre-incubation followed by the 60° C. assay, and was improved under the other conditions as well, so this variant was selected for further directed evolution.

Example 70

Beta-1,3-ADP-Glycosyltransferase Variants of SEQ ID NO: 6138

In this Example, experiments for evolution and screening of β1,3-glycosyltransferase (β1,3GT) polypeptides derived from SEQ ID NO: 6138 for improved glucosylation of steviol glycosides using in situ synthesized ADP-glucose are described. Directed evolution of the GT encoded by SEQ ID NO: 6137 (i.e., SEQ ID NO: 6138) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide an eighteenth round ("Round 18") of 100 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared *E. coli* culture lysates expressing SEQ ID NO: 6137 variants. Pellets were lysed, and lysate was cleared as described in Example 60, and then diluted 20-40× into 50 mM potassium phosphate buffer, pH 6. In order to thermally challenge the lysates, they were pre-incubated in a thermocycler for 15 minutes at 68.6° C. Assays were conducted with 10 µL pre-incubated lysate in 100 µL reactions and with 10 mM stevioside (>95% purity) or rebaudioside D substrate, 0.2 mM ADP (Sigma, >93% purity) co-substrate, 0.1 g/L SUS SFP SEQ ID NO:1840, and 24 mM sucrose (cane sugar). The following reaction conditions were used: 50 mM potassium phosphate buffer, pH6, 60° C. in a Thermotron® titre-plate shaker with 300 RPM shaking for 4h. Reactions were solubilized by 20× dilution with water, quenched by 5× dilution into acetonitrile with 0.2% formic acid, and diluted 10× with water for analysis.

Samples were analyzed by RapidFire-MS/MS as described in Example 31, Table 31.1. Glycosyltransferase variant polypeptides that produced rebaudioside A rebaudioside M from stevioside/rebaudioside D with in situ synthesized ADP-glucose at greater quantities than SEQ ID NO: 6138 were identified. The engineered polypeptides are listed in Table 70.1. Shake-flask scale cultures were grown, lysed, cleared, and lyophilized to powder as described in Example 31 for analysis of variants shown in Table 70.2 relative to SEQ ID NO: 6138.

TABLE 70.1

β1, 3GT Round 18 Variants and RebA and RebM Levels

| SEQ ID NO: (nt/aa) | Amino Acid Differences (Relative to SEQ ID NO: 6138) | Increased RebA[a] | Increased RebM[a] |
|---|---|---|---|
| 6261/6262 | V14I/E330D | ++ | +++ |
| 6263/6264 | E113S/D158P/L163A/K190R/L257Q/L437I | ++ | +++ |
| 6265/6266 | D158P/V320I/L437I/S449R | ++ | ++ |
| 6267/6268 | V14I/D158P/L163A/K190R/E342W/L437I | + | +++ |
| 6269/6270 | V14I/K190R/L257Q/S317R/V320I/P322L | + | ++ |
| 6271/6272 | V14I/E113S/D158P/L163A/K190R/L257Q/R308L/E342W | ++ | +++ |
| 6273/6274 | E113S/D158P/L163A/K190R/R308L/V320I | ++ | +++ |
| 6275/6276 | K190R/S449R | +++ | +++ |
| 6277/6278 | V14I/E113S/D158P/L163A | ++ | +++ |
| 6279/6280 | V14I/E113S/L163A/K190R/R308L/S317R | ++ | +++ |
| 6281/6282 | V14I/E113S/D158P | + | ++ |
| 6283/6284 | E113S/D158P/K190R/V320I/P322L/S449R | ++ | +++ |
| 6285/6286 | E113S/L257Q/S317R/P322L/L437I | + | ++ |
| 6287/6288 | E113S/D158P/V320I/P322L/L437I | +++ | +++ |
| 6289/6290 | E113S/D158P/K190R/L257Q/V320I | ++ | +++ |
| 6291/6292 | P322L/E330D | ++ | +++ |
| 6293/6294 | S317R/V320I/P322L/E330D | ++ | +++ |
| 6295/6296 | V14I/S449R | ++ | +++ |
| 6297/6298 | V14I/E113S/D158P/R308L/S317R/E330D/S449R | +++ | +++ |
| 6299/6300 | V14I/E113S/D158P/L163A/L437I | +++ | +++ |

TABLE 70.1-continued

β1, 3GT Round 18 Variants and RebA and RebM Levels

| SEQ ID NO: (nt/aa) | Amino Acid Differences (Relative to SEQ ID NO: 6138) | Increased RebA[a] | Increased RebM[a] |
|---|---|---|---|
| 6301/6302 | D158P/R308L/V320I/L437I | +++ | +++ |
| 6303/6304 | V14I/D158P/L163A/L257Q/R308L/S449R | ++ | +++ |
| 6305/6306 | D158P/L163A/R308L | + | +++ |
| 6307/6308 | V14I/L257Q/R308L/V320I/P322L/E330D | ++ | +++ |
| 6309/6310 | E113S/D158P/L163A/L257Q/R308L/S317R/P322L/L437I/S449R | ++ | +++ |
| 6311/6312 | V14I/L163A/S317R/V320I | + | +++ |
| 6313/6314 | V14I/D158P/L257Q/R308L/L437I/S449R | +++ | +++ |
| 6315/6316 | L163A/R308L/E330D/L437I/S449R | ++ | +++ |
| 6317/6318 | D158P/L163A | ++ | +++ |
| 6319/6320 | V14I/D158P/L163A/L257Q | + | +++ |
| 6321/6322 | V14I/D158P/S317R/V320I/E330D/L437I | +++ | +++ |
| 6323/6324 | V14I/E113S/V320I/L437I/S449R | +++ | +++ |
| 6325/6326 | E113S/L257Q/R308L | ++ | +++ |
| 6327/6328 | E113S/D158P/L163A/K190R/R308L/S317R/P322L | ++ | +++ |
| 6329/6330 | V14I/K190R | + | +++ |
| 6331/6332 | D158P/L163A/K190R/L257Q/R308L/E342W/S449R | + | +++ |
| 6333/6334 | V14I/D158P/L163A/K190R/L257Q/R308L/S317R/E330D/L437I | +++ | +++ |
| 6335/6336 | V14I/L257Q/R308L/P322L/E330D/L437I | +++ | +++ |
| 6337/6338 | V14I/E113S/L163A/L257Q/L437I | +++ | +++ |
| 6339/6340 | V14I/S317R | + | +++ |
| 6341/6342 | V14I/D158P | +++ | +++ |
| 6343/6344 | V14I/E113S/L163A/R308L/S317R/V320I/P322L/E330D/S449R | ++ | +++ |
| 6345/6346 | V14I/E113S/L163A/L257Q/R308L/E342W/L437I/S449R | +++ | +++ |
| 6347/6348 | D158P/L163A/P322L/L437I | +++ | +++ |
| 6349/6350 | L29M/D375P | + | ++ |
| 6351/6352 | G84H | ++ | + |
| 6353/6354 | R88T | + | + |
| 6355/6356 | D375A | + | + |
| 6357/6358 | Q197K | + | + |
| 6359/6360 | I202H | + | ++ |
| 6361/6362 | P83S | + | + |
| 6363/6364 | I202T | + | + |
| 6365/6366 | G84N | ++ | + |
| 6367/6368 | A85L | + | + |
| 6369/6370 | V19Q | + | + |
| 6371/6372 | A199M | + | + |
| 6373/6374 | I202Q | + | ++ |
| 6375/6376 | N383V | + | ++ |
| 6377/6378 | H81T | + | + |
| 6379/6380 | D375V | + | + |
| 6381/6382 | A199Y | + | + |
| 6383/6384 | D72S | + | + |
| 6385/6386 | D375P | +++ | +++ |
| 6387/6388 | D72T | + | + |
| 6389/6390 | P83N | + | + |
| 6391/6392 | R88K | + | + |
| 6393/6394 | V155L | ++ | ++ |
| 6395/6396 | A199H | + | + |
| 6397/6398 | T80P | + | + |
| 6399/6400 | Q71V | + | + |
| 6401/6402 | P83A | + | + |
| 6403/6404 | E209T | + | + |
| 6405/6406 | A199E | + | + |
| 6407/6408 | P83T | + | + |
| 6409/6410 | I202V | + | + |
| 6411/6412 | G84D | + | + |
| 6413/6414 | R88C | + | + |
| 6415/6416 | A199Q | +++ | ++ |
| 6417/6418 | D375T | + | ++ |
| 6419/6420 | R88A | + | + |
| 6421/6422 | P83K | + | + |
| 6423/6424 | R88H | + | + |
| 6425/6426 | S41A | + | ND |
| 6427/6428 | A366T | + | ND |
| 6429/6430 | A366V | ++ | ND |
| 6431/6432 | E105A | + | ND |
| 6433/6434 | S273R | ++ | ND |
| 6435/6436 | S273H | ++ | ND |
| 6437/6438 | V263T | + | ND |
| 6439/6440 | P168C | + | ND |
| 6441/6442 | L243I | +++ | ND |
| 6443/6444 | H95N | + | ND |

TABLE 70.1-continued

β1, 3GT Round 18 Variants and RebA and RebM Levels

| SEQ ID NO: (nt/aa) | Amino Acid Differences (Relative to SEQ ID NO: 6138) | Increased RebA[a] | Increased RebM[a] |
|---|---|---|---|
| 6445/6446 | A366S | + | ND |
| 6447/6448 | H46S | + | ND |
| 6449/6450 | S273A | + | ND |
| 6451/6452 | A366L | ++ | ND |
| 6453/6454 | A366C | +++ | ND |
| 6455/6456 | Y249S | + | ND |
| 6457/6458 | F45L | + | ND |
| 6459/6460 | P168T | + | ND | aLevels of increased production were determined relative to the reference polypeptide of SEQ ID NO: 6138, and defined as follows: "−" = production less than 0.9-fold; "+" = production at least 0.9-fold, but less than 1.5-fold; "++" = at least 1.5-fold, but less than 1.9-fold; and "+++" = at least 1.9-fold increased production, as compared to the reference polypeptide.
ND = not determined.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.006-0.2 g/L SFP in 100 μL total reaction volumes of 50 mM potassium phosphate buffer, pH6, 10 mM stevioside (>95% purity) or rebaudioside D, 0.2 mM ADP (Sigma, >93% purity) co-substrate, 0.1 g/L SUS SFP SEQ ID NO: 1804, and 24 mM sucrose (cane sugar). The reactions were incubated at 55° C. with no pre-incubation or at 60° C. following 15 minute pre-incubation at 68.6° C. in a Thermotron® titre-plate shaker with 300 RPM shaking for 4 hours. The reactions were solubilized by 20× dilution in water, quenched by 5× dilution in acetonitrile with 0.2% formic acid, cleared by centrifugation, and diluted 10× in water for analysis. Glycosylated products were detected in by SPE-QQQ as described in Example 31, Table 31.1.

TABLE 70.2

β1, 3GT Round 18 Shake Flask Powder Variants and RebA and RebM Levels

| SEQ ID NO: (nt/aa) | Amino Acid Differences (Relative to SEQ ID NO: 6138) | Increased RebA, 60° C[a] | Increased RebM, 60° C[a] |
|---|---|---|---|
| 6261/6262 | V14I/E330D | + | + |
| 6267/6268 | V14I/D158P/L163A/K190R/E342W/L437I | + | +++ |
| 6287/6288 | E113S/D158P/V320I/P322L/L437I | +++ | +++ |
| 6299/6300 | V14I/E113S/D158P/L163A/L437I | ++ | ++ |
| 6333/6334 | V14I/D158P/L163A/K190R/L257Q/R308L/S317R/E330D/L437I | ++ | ++ | aLevels of increased production were determined relative to the reference polypeptide of SEQ ID NO: 6138, at 0.025 g/L shake flask powder and defined as follows: "−" = production less than 1.08-fold; "+" = production at least 1.08-fold, but less than 1.5-fold; "++" = at least 1.5-fold, but less than 1.7-fold; and "+++" = at least 1.7-fold increased production, as compared to the reference polypeptide.

In these experiments, the five variants in Table 70.2 (SEQ ID NOS: 6262, 6268, 6288, 6300, and 6334) produced more rebaudioside A from stevioside and more rebaudioside M from rebaudioside D at 60° C. with pre-incubation than SEQ ID NO: 6138. SEQ ID NO: 6288 had the greatest improvement for conversion of stevioside to rebaudioside A under the conditions with pre-incubation followed by the 60° C. assay, and was the second most improved for rebaudioside D to M, so this variant was selected for further directed evolution.

Example 71

Beta-1,3-ADP-Glycosyltransferase Variants of SEQ ID NO: 6288

In this Example, experiments for evolution and screening of β1,3-glycosyltransferase (β1,3GT) polypeptides derived from SEQ ID NO: 6288 for improved glucosylation of steviol glycosides using in situ synthesized ADP-glucose are described. Directed evolution of the GT encoded by SEQ ID NO: 6287 (i.e., SEQ ID NO: 6288) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide an nineteenth round ("Round 19") of 108 engineered GT variant polypeptides with glucosyltransferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared E. coli culture lysates expressing SEQ ID NO: 6288 variants. Pellets were lysed, and lysate was cleared as described in Example 60 and then diluted 40× into 50 mM potassium phosphate buffer, pH 6. In order to thermally challenge the lysates, they were pre-incubated either in a thermocycler for 15 minutes at 73.5° C. or at 65° C. in a Thermotron® titre-plate shaker with 300 RPM shaking for 16 h. Assays were conducted with 10 μL pre-incubated lysate in 100 μL reactions and with 10 mM stevioside (>95% purity) or rebaudioside D substrate, 0.2 mM ADP (Sigma, >93% purity) co-substrate, 0.05 g/L SUS SFP SEQ ID NO: 2064, and 24 mM sucrose (cane sugar). The following reaction conditions were used: 50 mM potassium phosphate buffer, pH 6, 60° C. in a Thermotron® titre-plate shaker with 300 RPM shaking for 4 h. Reactions were solubilized by 20× dilution in water, quenched by 5× dilution in acetonitrile with 0.2% formic acid, and diluted 10× with water for analysis. Samples were analyzed by RapidFire-MS/MS as described in Example 31, Table 31.1. Glycosyltransferase variant polypeptides that produced rebaudioside A/rebaudioside M from stevioside/rebaudioside D with in situ synthesized ADP-glucose at greater quantities than SEQ ID NO: 6288 were identified. The engineered polypeptides from combinatorial libraries screened with the 15 minute pre-incubation are listed in Table 71.1, and those from saturation mutagenesis libraries screened with the 16 h pre-incubation are listed in Table 71.2. Shake-flask scale cultures were grown, lysed, cleared, and lyophilized to powder as described in Example 1 for analysis of variants shown in Table 71.3 relative to SEQ ID NO: 6288.

TABLE 71.1

β1, 3GT Round 19 Combinatorial Variants and RebA and RebM Levels

| SEQ ID NO: (nt/aa) | Amino Acid Differences (Relative to SEQ ID NO: 6288) | Increased RebA[a] | Increased RebM[a] |
|---|---|---|---|
| 6461/6462 | S37R/Q71L/K247C/R331K/V365I/D389E/L401F/L429W | + | +++ |
| 6463/6464 | P139K/S156C/K247L/D389E/L401F/A427R/A433L/S449R | + | ++++ |
| 6465/6466 | K247L/H248W/S449R | + | ++++ |
| 6467/6468 | P139K/S156C/L174P/D389E/L401F/A427R/A433L/S449R | ++ | ++++ |
| 6469/6470 | P139K/K247C/H248W/R331K/L401F/P417Q/K432L/S449R | + | ++++ |
| 6471/6472 | L174P/D389E/L429W/K432L/A433L/S449R | + | ++++ |
| 6473/6474 | D416S/K432L/A433L | + | ++++ |
| 6475/6476 | S37R/H248W/D389A/L401F/L429W | + | ++++ |
| 6477/6478 | Q71L/H248W/V365I/D389A/L401F | + | ++++ |
| 6479/6480 | P139K/S156C/H248W/D389A/L401F/D416S/A427R/L429W/A433L | + | ++++ |
| 6481/6482 | Q71L/P139K/D389A/A427R/L429W/K432L/A433L/S449R | + | +++ |
| 6483/6484 | S37R/Q71L/L125M/L174P/K247C/H248W/A427R | + | ++++ |
| 6485/6486 | S37R/L174P/L401F/E402L/A433L/S449R | + | ++++ |
| 6487/6488 | S156C/D389E/L401F/E402L/D416L/K432L/A433L | ++ | ++++ |
| 6489/6490 | S254Q/A427R/A433L | + | +++ |
| 6491/6492 | S156C/S254Q/R331K/V365I/A427R/K432L/S449R | ++ | +++ |
| 6493/6494 | A427R/K432L/S449R | +++ | ++++ |
| 6495/6496 | S37R/P139K/A427R/K432L/A433L/S449R | + | +++ |
| 6497/6498 | P139K/H248W/E402L/D416L/A427R/A433L/S449R | + | +++ |
| 6499/6500 | D416L/K432L/A433L/S449R | + | ++++ |
| 6501/6502 | K247C/A427R/K432L | + | ++++ |
| 6503/6504 | H248W/L401F/L429W/K432L/A433L | + | ++++ |
| 6505/6506 | H248W/R331K/A427R/L429W/A433L | ++ | +++ |
| 6507/6508 | A427R/K432L | +++ | +++ |
| 6509/6510 | P139K/S254Q/L401F/D416S/A427R/A433L/S449R/ | ++ | +++ |
| 6511/6512 | L174P/G329P/K432L/S449R | ++ | +++ |
| 6513/6514 | P139K/L401F/5449R | ++ | +++ |
| 6515/6516 | P139K/L174P/S254Q | ++ | +++ |
| 6517/6518 | P139K/L174P/V365I/L401F/E402L/A427R/A433L/S449R | +++ | ++++ |
| 6519/6520 | D389E/L401F/A427R/K432L | +++ | +++ |
| 6521/6522 | Q71L/A427R/K432L/A433L/S449R | + | ++++ |
| 6523/6524 | S37R/P139K/G329P/V365I/A427R/K432L/S449R | ++ | ++++ |
| 6525/6526 | Q71L/L174P/G329P/A427R/L429W/K432L/A433L | + | ++++ |
| 6527/6528 | R331K/V365I/L429W/K432L/A433L/S449R | ++ | ++++ |
| 6529/6530 | D416L/A427R/A433L/S449R | + | ++++ |
| 6531/6532 | S37R/H248W/R331K/D389E/A427R/A433L | + | ++++ |
| 6533/6534 | S37R/P139K/L429W/K432L/A433L | ++ | ++++ |
| 6535/6536 | S156C/H248W/L256M | + | ++++ |
| 6537/6538 | K247C/H248W/L401F | ++ | ++++ |
| 6539/6540 | S37R/R331K/K432L/A433L | ++ | ++++ |
| 6541/6542 | K247C/R331K/L401F/A427R/K432L/S449R | ++ | ++++ |
| 6543/6544 | D389A/L401F/D416S/K432L/S449R | ++ | +++ |
| 6545/6546 | P139K/L174P/H248W/R331K/D389A/L401F/S449R | ++ | ++++ |
| 6547/6548 | L174P/K247C/H248W/D389A/L401F/K432L/A433L | + | +++ |
| 6549/6550 | S254Q/V365I | ++ | +++ |
| 6551/6552 | P139K/S156C/V365I | + | +++ |
| 6553/6554 | P139K/S156C/K247C/V365I/L401F/A433L/S449R | + | ++++ |
| 6555/6556 | Q71L/H248W/S449R | ++ | +++ |
| 6557/6558 | Q71L/K432L/A433L | ++ | +++ |
| 6559/6560 | H248W/D416L | ++ | +++ |
| 6561/6562 | Q71L/S254Q/A433L/S449R | ++ | +++ |
| 6563/6564 | A433L/S449R | ++ | +++ |
| 6565/6566 | K247L/L401F | ++ | +++ |
| 6567/6568 | H248W/V365I/D389E/A427R/L429W/K432L/5449R | ++ | +++ |
| 6569/6570 | Q71L/L174P/V365I/A427R/K432L | + | +++ |
| 6571/6572 | P139K/S156C/H248W/D389E | ++ | +++ |
| 6573/6574 | P139K/H248W/S254A/5449R | ++ | +++ |
| 6575/6576 | L174P/V365I | ++ | +++ |
| 6577/6578 | H248W/S449R | ++ | +++ |
| 6579/6580 | H248W/D416L/S449R/ | ++ | +++ |
| 6581/6582 | K432L | + | +++ |

TABLE 71.1-continued

β1, 3GT Round 19 Combinatorial Variants and RebA and RebM Levels

| SEQ ID NO: (nt/aa) | Amino Acid Differences (Relative to SEQ ID NO: 6288) | Increased RebA[a] | Increased RebM[a] |
|---|---|---|---|
| 6583/6584 | P139K/H248W/K432L/A433L | ++ | ++++ |
| 6585/6586 | V365I/L401F/E402L/L429W/K432L/A433L | + | +++ |
| 6587/6588 | L401F/A427R | ++ | +++ |

[a]Levels of increased production were determined relative to the reference polypeptide of SEQ ID NO: 6288, and defined as follows: "−" = production less than that of the reference polypeptide; "+" = production at least that of the reference polypeptide, but less than 1.9-fold; "++" = at least 1.9-fold, but less than 2.5-fold; "+++" = at least 2.5-fold, but less than 7-fold; and "++++" = at least 7-fold increased production, relative to reference polypeptide.

TABLE 71.2

β1, 3GT Round 19 Saturation Mutagenesis Variants and RebA and RebM Levels

| SEQ ID NO: (nt/aa) | Amino Acid Differences (Relative to SEQ ID NO: 6288) | Increased RebA[a] | Increased RebM[a] |
|---|---|---|---|
| 6589/6590 | M87R | + | ++ |
| 6591/6592 | M144Q/S449R | +++ | +++ |
| 6593/6594 | I91Q | + | + |
| 6595/6596 | I91N/S449R | − | ++ |
| 6597/6598 | I91T/S449R | + | + |
| 6599/6600 | L25M/S449R | + | ++ |
| 6601/6602 | D69M/S449R | + | + |
| 6603/6604 | M87Q | ++ | ++ |
| 6605/6606 | M87K | ++ | +++ |
| 6607/6608 | T361C | +++ | +++ |
| 6609/6610 | L25I/S449R | + | + |
| 6611/6612 | M87A/S449R | + | +++ |
| 6613/6614 | M87E | ++ | +++ |
| 6615/6616 | A153V | + | + |
| 6617/6618 | A153T/S449R | +++ | + |
| 6619/6620 | L25Q/S449R | + | ++ |
| 6621/6622 | L25S | + | ++ |
| 6623/6624 | D69A | + | + |
| 6625/6626 | I91V | + | ++ |
| 6627/6628 | I91L | + | + |
| 6629/6630 | W233M/S449R | ND | +++ |
| 6631/6632 | S317Y | ND | +++ |
| 6633/6634 | W233V | ND | + |
| 6635/6636 | W233S | ND | +++ |
| 6637/6638 | A212L/S449R | ND | + |
| 6639/6640 | W233L/S449R | ND | ++ |
| 6641/6642 | V369K | ND | + |
| 6643/6644 | V421I | ND | + |
| 6645/6646 | W233C | ND | ++ |
| 6647/6648 | W233Q/S449R | ND | +++ |
| 6649/6650 | E6P | ND | − |
| 6651/6652 | K347P/S449R | ND | + |
| 6653/6654 | Q159R/S449R | ND | ++ |
| 6655/6656 | Q159K | ND | +++ |
| 6657/6658 | E288P/S449R | ND | ++ |
| 6659/6660 | H172S | ND | + |
| 6661/6662 | T5S/S449R | ND | + |
| 6663/6664 | W233G | ND | + |
| 6665/6666 | Q303C | ND | + |
| 6667/6668 | W233A | ND | ++ |
| 6669/6670 | R10K | ND | + |
| 6671/6672 | W233R | ND | ++ |
| 6673/6674 | H172T/S449R | ND | + |
| 6675/6676 | Q303V | ND | + |

[a]Levels of increased production were determined relative to the reference polypeptide of SEQ ID NO: 6288, and defined as follows: "−" = production less than that of the reference polypeptide; "+" = production at least that of the reference polypeptide, but less than 1.28-fold; "++" = at least 1.28-fold, but less than 1.5-fold; and "+++" = at least 1.5-fold increased production, relative to the reference polypeptide.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 μL and diluted to 0.006-0.2 g/L SFP in 100 μL total reaction volumes of 50 mM potassium phosphate buffer, pH6, 10 mM stevioside (>95% purity) or rebaudioside D, 0.2 mM ADP (Sigma, >93% purity) co-substrate, 0.05 g/L SUS SFP SEQ ID NO: 2064, and 24 mM sucrose (cane sugar). The reactions were incubated in a Thermotron® titre-plate shaker with 300 RPM shaking for 4 hours at 55° C. with no pre-incubation or at 60° C. following 15 minute pre-incubation at 73.5° C. The reactions were solubilized by 20× dilution in water, quenched by 5× dilution in acetonitrile with 0.2% formic acid, cleared by centrifugation, and diluted 10× with water for analysis. Glycosylated products were detected in by SPE-QQQ as described in Example 31, Table 31.1. A further thermostability characterization was conducted with the clarified shake flask lysates prior to lyophilization, as follows: lysates were diluted 400× in buffer and incubated in a thermocycler at a gradient of 55-70° C. for 16 h. To determine the percent of remaining activity, the pre-incubated lysates were assayed as described above, with either stevioside or rebaudioside D and 4h incubation at 60'C. The percent activity remaining is expressed as production at the high temperature divided by production at lowest pre-incubated temperature.

TABLE 71.3

β1, 3GT Round 19 Shake Flask Powder Variants and RebA, RebM, and Thermostability Levels

| SEQ ID NO: (nt/aa) | Amino Acid Differences (Relative to SEQ ID NO: 6288) | Increased RebA, 55° C[a] | Increased RebA, 60° C[a] | Increased RebM, 60° C[a] | % Activity Remaining[b] |
|---|---|---|---|---|---|
| 6467/6468 | P139K/S156C/L174P/D389E/L401F/A427R/A433L/S449R | + | ++ | +++ | +++ |
| 6493/6494 | A427R/K432L/S449R | + | ++ | ++ | ++ |
| 6517/6518 | P139K/L174P/V365I/L401F/E402L/A427R/A433L/S449R | − | + | ++ | +++ |

TABLE 71.3-continued

β1, 3GT Round 19 Shake Flask Powder Variants and RebA, RebM, and Thermostability Levels

| SEQ ID NO: (nt/aa) | Amino Acid Differences (Relative to SEQ ID NO: 6288) | Increased RebA, 55° C[a] | Increased RebA, 60° C[a] | Increased RebM, 60° C[a] | % Activity Remaining[b] |
|---|---|---|---|---|---|
| 6519/6520 | D389E/L401F/A427R/K432L | + | ++ | ++ | +++ |
| 6527/6528 | R331K/V365I/L429W/K432L/A433L/S449R | – | + | +++ | + |
| 6539/6540 | S37R/R331K/K432L/A433L | + | + | +++ | – |
| 6573/6574 | P139K/H248W/S254A/S449R | – | + | +++ | + |
| 6583/6584 | P139K/H248W/K432L/A433L | – | + | +++ | ++ |

[a]Levels of increased production were determined relative to the reference polypeptide of SEQ ID NO: 6288, at 0.025 g/L shake flask powder and defined as follows: "–" = production less than 0.9-fold; "+" = production at least 0.9-fold, but less than 3.2-fold; "++" = at least 3.2-fold, but less than 5.5-fold; and "+++" = at least 5.5-fold increased production, relative to reference polypeptide.
[b]The percent levels of activity remaining were determined following 16 h pre-incubation at 70° C. relative to each variant following 16 h pre-incubation at 55° C. and defined as follows: "–" = less than 20% of activity remained following 16 h pre-incubation at 55° C.; "+" = at least 20%, but less than 40% of the activity remained; "++" = at least 40%, but less than 60% of the activity remained; and "+++" = at least 60% of the activity remained.

In these experiments, the eight variants in Table 71.3 produced more rebaudioside A from stevioside and more rebaudioside M from rebaudioside D at 60° C. with pre-incubation than SEQ ID NO: 6288. SEQ ID NO: 6468 had the greatest improvement for conversion of rebaudioside D to rebaudioside M under the conditions with pre-incubation followed by the 60° C. assay and had the greatest percent activity remaining following 16 h thermochallenge, so this variant was selected for further directed evolution.

Example 72

Beta-1,3-ADP-Glycosyltransferase Variants of SEQ ID NO: 6468

In this Example, experiments for evolution and screening of β1,3-glycosyltransferase (β1,3GT) polypeptides derived from SEQ ID NO: 6468 for improved glucosylation of steviol glycosides using in situ synthesized ADP-glucose are described. Directed evolution of the GT encoded by SEQ ID NO: 6467 (i.e., SEQ ID NO: 6468) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide a twentieth round ("Round 20") of 269 engineered GT variant polypeptides with glucosyl-transferase activity toward ADP-glucose and steviol glycosides.

HTP Assay for Glucose Transfer from Sucrose to ADP and then from ADP-Glucose to Stevioside and Rebaudioside D Assays were performed on 96-well plates of cleared E. coli culture lysates expressing SEQ ID NO: 6467 variants. Pellets were lysed, and lysate was cleared as described in Example 60, and then diluted 40× into 50 mM potassium phosphate buffer, pH 6. In order to thermally challenge the lysates, they were pre-incubated either in a thermocycler for 15 minutes at 79° C. or at 65° C. in a Thermotron® titre-plate shaker with 300 RPM shaking for 16 h. Assays were conducted with 10 μL pre-incubated lysate in 100 μL reactions and with 15 mM stevioside (>95% purity) or rebaudioside D substrate, 0.1 g/L ADP (Sigma, >93% purity) co-substrate, 0.05 g/L SUS SFP SEQ ID NO: 2432, and 37.5 mM sucrose (cane sugar). The following reaction conditions were used: 50 mM potassium phosphate buffer, pH 6, 60° C. in a Thermotron® titre-plate shaker with 300 RPM shaking for 4 h. Reactions were solubilized by 20× dilution with water, quenched by 5× dilution in acetonitrile with 0.2% formic acid, and diluted 15× with water for analysis. Samples were analyzed by RapidFire-MS/MS as described in Example 31, Table 31.1. Glycosyltransferase variant polypeptides that produced rebaudioside A/rebaudioside M from stevioside/rebaudioside D with in situ synthesized ADP-glucose at greater quantities than SEQ ID NO: 6468 were identified. The engineered polypeptides from combinatorial libraries screened with the 15 minute pre-incubation are listed in Table 72.1, and those from saturation mutagenesis libraries screened with the 16 h pre-incubation are listed in Table 72.2. Shake-flask scale cultures were grown, lysed, cleared, and lyophilized to powder as described in Example 31 for analysis of variants shown in Table 72.3 relative to SEQ ID NO: 6468.

TABLE 72.1

β1, 3GT Round 20 Combinatorial Variants and RebA and RebM Levels

| SEQ ID NO: (nt/aa) | Amino Acid Differences (Relative to SEQ ID NO: 6468) | Increased RebA[a] | Increased RebM[a] |
|---|---|---|---|
| 6677/6678 | D72T/P83S/G84N/R88T/I202H/S254A/S273R/A366C/D375P | ++ | ++ |
| 6679/6680 | F45L/D72T/R88T/A366C | ++ | ++ |
| 6681/6682 | P83S/R88T/V155L/S273R/A366V/D375P | ++ | +++ |
| 6683/6684 | H81T/R88T/D375P/E402L | ++ | +++ |
| 6685/6686 | S37R/D72T/Q197K/S273R/R331K/D375P/K432L | ++ | +++ |
| 6687/6688 | D72T/V155L/K190R | ++ | +++ |
| 6689/6690 | H248W/D375P | ++ | +++ |
| 6691/6692 | D72T/H248W | ++ | +++ |
| 6693/6694 | H81T/P83S/I202H/V365I/A366C/E402L | + | +++ |

TABLE 72.1-continued

β1, 3GT Round 20 Combinatorial Variants and RebA and RebM Levels

| SEQ ID NO: (nt/aa) | Amino Acid Differences (Relative to SEQ ID NO: 6468) | Increased RebA[a] | Increased RebM[a] |
|---|---|---|---|
| 6695/6696 | A199Q/V263T/R331K/V365I/A366C | ++ | ++ |
| 6697/6698 | V365I/A366C | ++ | ++ |
| 6699/6700 | F45L/D72T/P168T/L243I/R331K/V365I/A366C/L429W/K432L | ++ | ++ |
| 6701/6702 | D72T/P83S/R88T/L243I/V263T/R331K/V365I/A366C | ++ | ++ |
| 6703/6704 | H81T/P83S/K190R/V263T/V365I/A366C | ++ | +++ |
| 6705/6706 | S37R/D72T/H81T/P83S/R88T/V155L/K190R | ++ | ++ |
| 6707/6708 | F45L/D72T/G84N/R88T/Q197K/D375P | ++ | ++++ |
| 6709/6710 | G84N/Q197K/A366C/E402L | + | +++ |
| 6711/6712 | F45L/L163A/P168T/K190R/A199Q/A366C/L429W/K432L | ++ | ++ |
| 6713/6714 | G84N/V155L/P168T/Q197K/A199Q/R331K/A366V/D375P/N383V/E402L | ++ | + |
| 6715/6716 | K190R/A199Q/I202H/R331K/A366C | + | ++++ |
| 6717/6718 | S37R/K190R/I202H | + | +++ |
| 6719/6720 | D72T/P83S/G84N/Q197K/I202H/L243I/V263T/V365I/A366C | ++ | +++ |
| 6721/6722 | Q197K/A199Q/I202H | − | +++ |
| 6723/6724 | G84N/P168T/Q197K/I202H/V263T/A366C | + | +++ |
| 6725/6726 | Q197K/I202H/H248W | + | ++++ |
| 6727/6728 | Q197K/H248W | ++ | ++++ |
| 6729/6730 | S37R/P83S/V263T/V365I/A366V/D375P | ++ | +++ |
| 6731/6732 | F45L/L163A/P168T/Q197K/V263T/R331K/V365I/A366C | + | +++ |
| 6733/6734 | F45L/D72T/L163A/I202H/V365I/A366V/D375P | ++ | ++++ |
| 6735/6736 | D72T/H81T/G84N/K190R/H248W | ++ | +++ |
| 6737/6738 | H81T/P83S/E169D/K190R/V263T | ++ | +++ |
| 6739/6740 | F45L/G84N/P168T/K190R/A199Q/S254A/S273R/V365I/A366C | ++ | + |
| 6741/6742 | V365I/D375P/E402L | + | +++ |
| 6743/6744 | V155L/P168T/K190R/Q197K/A199Q/A366C | ++ | +++ |
| 6745/6746 | S37R/S41A/F45L/D72T/V155L/K190R/L243I/H248W/S273R/R331K/K432L/L433A | + | +++ |
| 6747/6748 | S37R/S41A/F45L/D72T/V155L/L163A/R331K/A366C/D375P | ++ | +++ |
| 6749/6750 | D72T/H81T/P83S/G84N/R88T/V155L/K190R | ++ | ++ |
| 6751/6752 | V155L/V263T/A366C/K432L/L433A | ++ | +++ |
| 6753/6754 | S37R/S41A/F45L/D72T/V155L/V263T/D375P | ++ | +++ |
| 6755/6756 | S37R/S41A/F45L/V155L/A366C/K432L/L433A | ++ | +++ |
| 6757/6758 | D72T/H81T/P83S/G84N/R88T/L163A/P168T/V263T/R331K/D375P | ++ | ++ |
| 6759/6760 | S37R/S41A/F45L/V155L/A366C | ++ | ++ |
| 6761/6762 | S37R/S41A/F45L/D72T/V155L/L163A/P168T/L243I/H248W/S273R/R331K/A366V/K432L/L433A | + | +++ |
| 6763/6764 | S37R/S41A/F45L/D72T/V155L/K190R/S273R/R331K/A366V/D375P | ++ | ++ |
| 6765/6766 | S37R/S41A/F45L/L243I/H248W/S273R/R331K | + | ++ |
| 6767/6768 | S37R/S41A/F45L/H81T/P83S/G84N/R88T/L163A/P168T/V263T/S273R/R331K/A366C/D375P | ++ | ++ |
| 6769/6770 | S37R/S41A/F45L/D72T/V155L/K190R/S273R/A366C | ++ | +++ |
| 6771/6772 | S37R/S41A/F45L/V155L/P168T/H248W/S273R/R331K/D375P | + | ++ |
| 6773/6774 | S37R/S41A/F45L/V155L/L163A/P168T/V263T/R331K/D375P | ++ | +++ |
| 6775/6776 | S37R/S41A/F45L/D72T/V155L/R331K/A366V/D375P/K432L/L433A | ++ | +++ |
| 6777/6778 | S37R/S41A/F45L/V155L/K190R/R331K/A366V/D375P | ++ | +++ |
| 6779/6780 | H81T/P83S/G84N/R88T/V155L/L163A/P168T/S273R/R331K/D375P | ++ | ++ |
| 6781/6782 | D72T/H81T/P83S/G84N/R88T/L163A/P168T/K190R/L243I/V263T/R331K/A366C | ++ | ++ |
| 6783/6784 | S37R/S41A/F45L/D72T/V155L/H248W/V263T/S273R/A366C | ++ | +++ |
| 6785/6786 | V155L/P168T/D375P | ++ | +++ |
| 6787/6788 | S41A/F45L/L163A/P168T/L243I/H248W/S273R/A366C/K432L | + | +++ |
| 6789/6790 | S37R/S41A/F45L/V155L/D375P | ++ | +++ |
| 6791/6792 | D72T/L243I/H248W/A366V/K432L/L433A | + | +++ |
| 6793/6794 | D72T/L243I/H248W/S273R/A366V/K432L/L433A | + | +++ |
| 6795/6796 | S37R/S41A/F45L/D72T/V155L/V263T/R331K/D375P | ++ | +++ |
| 6797/6798 | D72T/V155L/S273R/R331K/D375P/K432L | ++ | +++ |
| 6799/6800 | D72T/L243I/H248W/V263T/A366V/K432L/L433A | ++ | +++ |
| 6801/6802 | S37R/S41A/F45L/D72T/H81T/P83S/G84N/R88T/V155L/R331K/A366C/D375P | ++ | ++ |

TABLE 72.1-continued

β1, 3GT Round 20 Combinatorial Variants and RebA and RebM Levels

| SEQ ID NO: (nt/aa) | Amino Acid Differences (Relative to SEQ ID NO: 6468) | Increased RebA[a] | Increased RebM[a] |
|---|---|---|---|
| 6803/6804 | S37R/S41A/F45L/H81T/P83S/G84N/R88T/V155L/P168T/R331K/D375P | ++ | ++ |
| 6805/6806 | S37R/S41A/F45L/D72T/H81T/P83S/G84N/R88T/V155L/R331K/D375P | ++ | ++ |
| 6807/6808 | S37R/S41A/F45L/D72T/V155L/K190R/H248W/V263T/R331K | ++ | +++ |
| 6809/6810 | S37R/S41A/F45L/D72T/V263T/A366C/K432L/L433A | ++ | +++ |
| 6811/6812 | S37R/S41A/F45L/D72T/V155L/S273R/A366C | ++ | ++ |
| 6813/6814 | S37R/S41A/F45L/D72T/H81T/P83S/G84N/R88T/V155L/V263T/S273R/R331K/D375P/K432L | ++ | ++ |
| 6815/6816 | S37R/S41A/F45L/V263T/R331K/D375P/K432L | ++ | +++ |
| 6817/6818 | S37R/S41A/F45L/D72T/R331K/A366C | ++ | ++ |
| 6819/6820 | H81T/P83S/G84N/R88T/V263T/S273R/R331K/A366C/K432L | ++ | ++ |
| 6821/6822 | H81T/P83S/G84N/R88T/V155L/A366C | ++ | ++ |
| 6823/6824 | S37R/S41A/F45L/D72T/R88T/V155L/P168T/K190R/R331K/A366C/D375P/K432L | ++ | ++ |
| 6825/6826 | S37R/S41A/F45L/D72T/V155L/L163A/P168T/V263T/A366C/K432L/L433A | ++ | ++ |
| 6827/6828 | H81T/P83S/G84N/R88T/V155L/V263T/A366V/D375P | ++ | ++ |
| 6829/6830 | S37R/S41A/F45L/D72T/V155L/L163A/P168T/K190R/L243I/V263T/S273R/R331K/A366C/K432L | ++ | ++ |
| 6831/6832 | S37R/S41A/F45L/D72T/H81T/P83S/G84N/R88T/H248W/D375P | ND | + |
| 6833/6834 | D72T/H81T/P83S/G84N/R88T/V155L/L163A/P168T/K190R/A366C | ++ | + |
| 6835/6836 | S37R/S41A/F45L/D72T/V155L/K190R/V263T/R331K/A366C | ++ | ++ |
| 6837/6838 | D72T/V155L/K190R/A366C | ++ | ++ |
| 6839/6840 | S37R/S41A/F45L/D72T/K190R/V263T/S273R/R331K | ND | ++ |
| 6841/6842 | D72T/V155L/K190R/V263T/R331K/A366C | ++ | ++ |
| 6843/6844 | S37R/S41A/F45L/D72T/K190R/A366C | ++ | ++ |
| 6845/6846 | H81T/P83S/G84N/R88T/K190R/V263T/D375P | ++ | ++ |
| 6847/6848 | D72T/H81T/P83S/G84N/R88T/V155L/A366C | ++ | ++ |
| 6849/6850 | D72T/H81T/P83S/G84N/R88T/V155L/S273R/R331K/D375P | ++ | ++ |
| 6851/6852 | S37R/S41A/F45L/R331K/A366V/K432L/L433A | ++ | + |
| 6853/6854 | S37R/S41A/F45L/D72T/R88T/V155L/P168T/K190R/R331K/D375P | ++ | ++ |
| 6855/6856 | S37R/S41A/F45L/D72T/H81T/P83S/G84N/R88T/V155L/L163A/P168T/K190R/R331K/D375P | ++ | ++ |
| 6857/6858 | D72T/H81T/P83S/G84N/R88T/V155L/K190R/S273R/R331K/A366V/K432L | ++ | ++ |
| 6859/6860 | S41A/F45L/D72T/V155L/V263T/R331K/A366V/D375P/K432L/L433A | ++ | ++ |
| 6861/6862 | S37R/S41A/F45L/D72T/H81T/P83S/G84N/R88T/R331K/A366V/K432L/L433A | ++ | ++ |
| 6863/6864 | S37R/S41A/F45L/D72T/K190R/R331K/A366C | ++ | ++ |
| 6865/6866 | S37R/S41A/F45L/H81T/P83S/G84N/R88T/V155L/P168T/K190R/L243I/R331K/A366C | ++ | + |
| 6867/6868 | S37R/S41A/F45L/H81T/P83S/G84N/R88T/V155L/V263T/S273R/R331K/A366C | ++ | ++ |
| 6869/6870 | S37R/S41A/F45L/D72T/R88T/K190R/V263T/S273R/R331K/A366C | ++ | ++ |
| 6871/6872 | S37R/S41A/F45L/D72T/V263T/R331K/A366C | ++ | ++ |
| 6873/6874 | H81T/P83S/G84N/R88T/V155L/K190R/V263T/R331K/A366C | ++ | ++ |
| 6875/6876 | S37R/S41A/F45L/D72T/V155L/K190R/S273R/A366C/D375P/K432L | ++ | ++ |
| 6877/6878 | D72T/V155L/L163A/P168T/K190R/A366V/K432L/L433A | ++ | ++ |

[a] Levels of increased production were determined relative to the reference polypeptide of SEQ ID NO: 6468, and defined as follows: "−" = production at least that of the reference polypeptide; "+" = at least that of the reference polypeptide, but less than 2-fold; "++" = at least 2-fold, but less than 4-fold; "+++" = at least 4-fold, but less than 8-fold; and "++++" = at least 8-fold increased production, as compared to the reference polypeptide.
ND = not determined.

TABLE 72.2

β1, 3GT Round 20 Saturation Mutagenesis Variants and RebA Levels

| SEQ ID NO: (nt/aa) | Amino Acid Differences (Relative to SEQ ID NO: 6468) | Increased RebA[a] |
|---|---|---|
| 6879/6880 | L322K | +++ |
| 6881/6882 | R435S | +++ |
| 6883/6884 | V9K | + |
| 6885/6886 | P439G | + |
| 6887/6888 | Q265H | + |
| 6889/6890 | S253D | + |
| 6891/6892 | S61Q | +++ |
| 6893/6894 | P2Q | + |
| 6895/6896 | P2H | + |
| 6897/6898 | N408S | + |
| 6899/6900 | P439A | ++ |
| 6901/6902 | K428R | ++ |
| 6903/6904 | D170A | + |
| 6905/6906 | G96K | + |
| 6907/6908 | D98E | + |
| 6909/6910 | K171Q | + |
| 6911/6912 | R296Q | + |
| 6913/6914 | A118V | ++ |
| 6915/6916 | L229M | + |
| 6917/6918 | P2K | +++ |
| 6919/6920 | S253P | +++ |
| 6921/6922 | K222Q | ++ |
| 6923/6924 | P439H | ++ |
| 6925/6926 | A118T/L120V | ++ |
| 6927/6928 | T4N | + |
| 6929/6930 | M183L | ++ |
| 6931/6932 | Q269N | ++ |
| 6933/6934 | S253T | +++ |
| 6935/6936 | P272S | + |
| 6937/6938 | R435Y | ++ |
| 6939/6940 | K289N | + |
| 6941/6942 | S253V | + |
| 6943/6944 | K222A | ++ |
| 6945/6946 | A438S | ++ |
| 6947/6948 | R435G | ++ |
| 6949/6950 | S442T | + |
| 6951/6952 | R435D | ++ |
| 6953/6954 | L322P/V407I | + |
| 6955/6956 | E226S | + |
| 6957/6958 | D170V | + |
| 6959/6960 | P2R | + |
| 6961/6962 | L322V/V407I | +++ |
| 6963/6964 | R173K | ++ |
| 6965/6966 | N399S | + |
| 6967/6968 | N3M | ++ |
| 6969/6970 | M183I | +++ |
| 6971/6972 | K428L | + |
| 6973/6974 | K302G | + |
| 6975/6976 | K222R | + |
| 6977/6978 | R435N | ++ |
| 6979/6980 | Q269R | +++ |
| 6981/6982 | R435E | +++ |
| 6983/6984 | V9S | ++ |
| 6985/6986 | S442F | +++ |
| 6987/6988 | Y396T | ++ |
| 6989/6990 | K428I | +++ |
| 6991/6992 | S214R | ++ |
| 6993/6994 | E405P | + |
| 6995/6996 | R234S | + |
| 6997/6998 | P439E | + |
| 6999/7000 | N3F | + |
| 7001/7002 | V390I | +++ |
| 7003/7004 | P439R | + |
| 7005/7006 | Y193F | ++ |
| 7007/7008 | R403V | ++ |
| 7009/7010 | K171L | + |
| 7011/7012 | P158T | + |
| 7013/7014 | N408D | + |
| 7015/7016 | G96C | + |
| 7017/7018 | K171A | ++ |
| 7019/7020 | Q269M | + |
| 7021/7022 | D300E | + |
| 7023/7024 | K222N | + |
| 7025/7026 | D170G | + |
| 7027/7028 | P2M | + |
| 7029/7030 | K428Y | + |
| 7031/7032 | K94R | + |
| 7033/7034 | L322T | ++ |
| 7035/7036 | E448Q | + |
| 7037/7038 | D98T | ++ |
| 7039/7040 | N3L | + |
| 7041/7042 | R411K | ++ |
| 7043/7044 | D170H | + |
| 7045/7046 | Q269L | + |
| 7047/7048 | K171P | +++ |
| 7049/7050 | E405S | ++ |
| 7051/7052 | M183P | ++ |
| 7053/7054 | V395I/P439V | +++ |
| 7055/7056 | L322S | +++ |
| 7057/7058 | V9A | + |
| 7059/7060 | R449L | + |
| 7061/7062 | Y165L | +++ |
| 7063/7064 | A438E | + |
| 7065/7066 | R234T | ++ |
| 7067/7068 | L229Q | + |
| 7069/7070 | K428G | ++ |
| 7071/7072 | N399P | +++ |
| 7073/7074 | F64M | + |
| 7075/7076 | E330S | ++ |
| 7077/7078 | N408K | + |
| 7079/7080 | D434G | + |
| 7081/7082 | E405T | + |
| 7083/7084 | N399Q | ++ |
| 7085/7086 | R435L | ++ |
| 7087/7088 | R435V | + |
| 7089/7090 | P2F | ++ |
| 7091/7092 | E448K | + |
| 7093/7094 | F64L | + |
| 7095/7096 | K53E/I437T | +++ |
| 7097/7098 | R411H | + |
| 7099/7100 | K428V | +++ |
| 7101/7102 | K428T | ++ |
| 7103/7104 | R173L | + |
| 7105/7106 | D98S | + |
| 7107/7108 | P439W | + |
| 7109/7110 | Y396V | + |
| 7111/7112 | S113P | ++ |
| 7113/7114 | K428Q | +++ |
| 7115/7116 | V9M | + |
| 7117/7118 | A438R | ++ |
| 7119/7120 | D434E | +++ |
| 7121/7122 | R411T | +++ |
| 7123/7124 | R234N | ++ |
| 7125/7126 | K428S | +++ |
| 7127/7128 | D300A | + |
| 7129/7130 | R173S | + |
| 7131/7132 | K289R | + |
| 7133/7134 | L322P | +++ |
| 7135/7136 | S113G | + |
| 7137/7138 | R423T | + |
| 7139/7140 | P439M | + |
| 7141/7142 | E405A | + |
| 7143/7144 | S214R/K222H | + |
| 7145/7146 | D72E/D170A | ++ |
| 7147/7148 | T4S | +++ |
| 7149/7150 | R449G | + |
| 7151/7152 | D134E/P158N | +++ |
| 7153/7154 | R435K | + |
| 7155/7156 | L322A | ++ |
| 7157/7158 | S452T | + |
| 7159/7160 | R412K | +++ |
| 7161/7162 | A118C | + |
| 7163/7164 | Y444A | + |
| 7165/7166 | E405D | + |
| 7167/7168 | L120V | ++ |
| 7169/7170 | S253E | +++ |

TABLE 72.2-continued

β1, 3GT Round 20 Saturation Mutagenesis Variants and RebA Levels

| SEQ ID NO: (nt/aa) | Amino Acid Differences (Relative to SEQ ID NO: 6468) | Increased RebA[a] |
|---|---|---|
| 7171/7172 | P2V | + |
| 7173/7174 | D170P | ++ |
| 7175/7176 | K289G | + |
| 7177/7178 | K428E | ++ |
| 7179/7180 | V390R | + |
| 7181/7182 | S304P | + |
| 7183/7184 | S214K | ++ |
| 7185/7186 | R173I | + |
| 7187/7188 | S113D | +++ |
| 7189/7190 | R435I | +++ |
| 7191/7192 | D72E/E405S | ++ |
| 7193/7194 | R435A | + |
| 7195/7196 | E398S | + |
| 7197/7198 | I454V | ++ |
| 7199/7200 | R449S | + |
| 7201/7202 | K428N | +++ |
| 7203/7204 | V9G | ++ |
| 7205/7206 | K289D | + |
| 7207/7208 | S304K | ++ |
| 7209/7210 | L322G | ++ |
| 7211/7212 | A129P | + |
| 7213/7214 | S253N | + |

[a]Levels of increased production were determined relative to the reference polypeptide of SEQ ID NO: 6468, and defined as follows: "+" = production at least 1.05-fold, but less than 1.14-fold; "++" = at least 1.14-fold, but less than 1.2-fold; and "+++" = at least 1.2-fold increased production as compared to the reference polypeptide.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.006-0.2 g/L SFP in 100 µL total reaction volumes of 50 mM potassium phosphate buffer, pH 6, 15 mM stevioside (>95% purity) or rebaudioside D, 0.2 mM ADP (Amresco, ultra pure grade) co-substrate, 0.05 g/L SUS SFP SEQ ID NO: 2432, and 37.5 mM sucrose (cane sugar). The reactions were incubated in a Thermotron® titre-plate shaker with 300 RPM shaking for 4 hours at 55° C. with no pre-incubation or at 60° C. following 15 minute pre-incubation at 79° C. The reactions were solubilized by 20× dilution with water, quenched by 5× dilution in acetonitrile with 0.2% formic acid, cleared by centrifugation, and diluted 15× with water for analysis. Glycosylated products were detected in by SPE-QQQ as described in Example 31, Table 31.1. A further thermostability characterization was conducted with the clarified shake flask lysates prior to lyophilization as follows: lysates were diluted 400× in buffer and incubated in a thermocycler at a gradient of 60-75° C. for 16 h. To determine the percent activity remaining, the pre-incubated lysates were assayed as described above with either stevioside or rebaudioside D and 4 h incubation at 60° C. The percent of the remaining activity is expressed as production at the high temperature divided by production at lowest pre-incubated temperature.

TABLE 72.3

β1, 3GT Round 20 Shake Flask Powder Variants and RebA, RebM, and Thermostability Levels

| SEQ ID NO: (nt/aa) | Amino Acid Differences (Relative to SEQ ID NO: 6468) | Increased RebA, 55° C.[a] | Increased RebA, 60° C.[a] | Increased RebM, 60° C.[a] | % Activity Remaining[b] |
|---|---|---|---|---|---|
| 6739/6740 | F45L/G84N/P168T/K190R/ A199Q/S254A/S273R/ V365I/A366C | + | +++ | ++ | + |
| 6873/6874 | H81T/P83S/G84N/R88T/ V155L/K190R/V263T/ R331K/A366C | + | +++ | + | + |
| 6863/6864 | S37R/S41A/F45L/D72T/ K190R/R331K/A366C | + | ++ | ++ | + |
| 6755/6756 | S37R/S41A/F45L/V155L/ A366C/K432L/L433A | + | +++ | ++ | ++ |
| 6809/6810 | S37R/S41A/F45L/D72T/ V263T/A366C/K432L/L433A | + | +++ | ++ | ++ |
| 6743/6744 | V155L/P168T/K190R/ Q197K/A199Q/A366C | + | ++ | + | + |
| 6695/6696 | A199Q/V263T/R331K/ V365I/A366C | + | +++ | + | ++ |
| 6837/6838 | D72T/V155L/K190R/A366C | + | ++ | ++ | − |
| 6849/6850 | D72T/H81T/P83S/G84N/ R88T/V155L/S273R/ R331K/D375P | + | ++ | + | ++ |
| 6707/6708 | F45L/D72T/G84N/ R88T/Q197K/D375P | + | +++ | + | +++ |
| 6681/6682 | P83S/R88T/V155L/ S273R/A366V/D375P | − | +++ | ++ | ++ |

TABLE 72.3-continued

β1, 3GT Round 20 Shake Flask Powder Variants and RebA, RebM, and Thermostability Levels

| SEQ ID NO: (nt/aa) | Amino Acid Differences (Relative to SEQ ID NO: 6468) | Increased RebA, 55° C.[a] | Increased RebA, 60° C.[a] | Increased RebM, 60° C.[a] | % Activity Remaining[b] |
|---|---|---|---|---|---|
| 6697/6698 | V365I/A366C | − | + | + | + |
| 6785/6786 | V155L/P168T/D375P | − | ++ | ++ | +++ |
| 6725/6726 | Q197K/I202H/H248W | − | + | ++ | ++ |

[a]Levels of increased production were determined relative to the reference polypeptide of SEQ ID NO: 6468, at 0.025 g/L shake flask powder and defined as follows:
"−" = production less than that of the reference polypeptide;
"+" = production at least that of the reference polypeptide, but less than 1.8-fold;
"++" = at least 1.8-fold, but less than 2.5-fold; and
"+++" = at least 2.5-fold increased production, relative to reference polypeptide.
[b]The percent of activity remaining for each variant was determined following 16 h pre-incubation at 70° C., relative to the production of each variant following 16 h pre-incubation at 60° C., and defined as follows:
"−" = less than 40% of activity remained following 16 h pre-incubation at 60° C.;
"+" = at least 40%, but less than 60% of the activity remained;
"++" = at least 60%, but less than 80% of the activity remained; and
"+++" = at least 80% of the activity remained.

In these experiments, the fourteen variants in Table 72.3 produced more rebaudioside A from stevioside and more rebaudioside M from rebaudioside D at 60° C. with pre-incubation than SEQ ID NO: 6468, and all but four also outperformed at 55° C. without pre-incubation. SEQ ID NO: 6864 was selected as the best enzyme for the catalysis of glycosyltransfer from ADP-glucose to stevioside and rebaudioside D for the formation of rebaudioside A and rebaudioside M, respectively.

Example 73

Beta-1,3-ADP-Glycosyltransferase Variants of SEQ ID NO: 6864

In this Example, experiments for evolution and screening of β1,3-glycosyltransferase (β1,3GT) polypeptides derived from SEQ ID NO: 6864 for improved glucosylation of steviol glycosides using in situ synthesized ADP-glucose are described. Directed evolution of the GT encoded by SEQ ID NO: 6863 (i.e., SEQ ID NO: 6864) was carried out by constructing libraries of variant genes in which mutations associated with improved production identified during the development of the present invention were recombined. These libraries were then plated, grown, and screened using the high-throughput (HTP) assay described below to provide a twenty-first round ("Round 21") of 37 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared E. coli culture lysates expressing SEQ ID NO: 6863 variants. Pellets were lysed, and lysate was cleared as described in Example 34 and then diluted 40× into 50 mM potassium phosphate buffer, pH 6. In order to thermally challenge the lysates, they were pre-incubated at 75° C. in a Thermotron® titre-plate shaker with 300 RPM shaking for 1h. Assays were conducted with 10 μL pre-incubated lysate in 100 μL reactions and with 20 g/L rebaudioside A60% substrate, 0.1 g/L ADP (Amresco, ultra pure grade) co-substrate, 0.05 g/L SUS SFP SEQ ID NO: 2510, 0.1 g/L β-1,2-glycosyltransferase/ (β12GT) SEQ ID NO:4550 and 37.5 mM sucrose (cane sugar). The following reaction conditions were used: 50 mM potassium phosphate buffer, pH 6, 60° C. in a Thermotron® titre-plate shaker with 300 RPM shaking for 4h. Reactions were solubilized by 20× dilution with water, quenched by 5× dilution with acetonitrile with 0.2% formic acid, and diluted 15× with water for analysis. Samples were analyzed by RapidFire-MS/MS as described in Example 31, Table 31.1. Glycosyltransferase variant polypeptides that produced rebaudioside A/rebaudioside M from stevioside/rebaudioside D with in situ synthesized ADP-glucose at greater quantities than SEQ ID NO: 6864 were identified. The engineered polypeptides are listed in Table 73.1. Shake-flask scale cultures were grown, lysed, cleared, and lyophilized to powder as described in Example 31 for analysis of variants shown in Table 73.2 relative to SEQ ID NO: 6864.

TABLE 73.1

β1, 3GT Round 21 Combinatorial Variants and RebM Levels

| SEQ ID NO: (nt/aa) | Amino Acid Differences (Relative to SEQ ID NO: 6864) | Increased RebM[a] |
|---|---|---|
| 7361/7362 | R109W/M144Q/A153V/V155L/Q159K/L433A | + |
| 7363/7364 | M87K/M144Q | +++ |
| 7365/7366 | M87K/M144Q/Q159K/T361C | + |
| 7367/7368 | M87K/L433A | + |
| 7371/7372 | M144Q | +++ |
| 7373/7374 | M87K/M144Q/Q159K/T361C/L433A | + |
| 7375/7376 | R88T/M144Q/Q159K | +++ |
| 7377/7378 | R88T/M144Q | ++ |
| 7379/7380 | T5S/D69A/I91Q/A212L/Q303V | ++ |
| 7381/7382 | V263T/E288P/Q303V/S317Y | ++ |
| 7383/7384 | T5S/E6P/D69A/E288P/Q303V | ++ |
| 7385/7386 | T5S/L25Q/E288P | + |
| 7387/7388 | T5S/E6P/I91Q/E288P/S317Y | +++ |
| 7389/7390 | T5S/I91Q/S317Y/V421I | + |
| 7391/7392 | L25Q/I91Q/V263T/E288P/Q303V | + |
| 7393/7394 | E288P | + |
| 7395/7396 | T5S/L25Q/I91Q/V263T | + |
| 7397/7398 | T5S/I91Q/Q303V | ++ |
| 7399/7400 | T5S/E288P | ++ |
| 7401/7402 | E6P/A212L/E288P/Q303V | + |
| 7403/7404 | L25Q/191T/Q303V/S317Y/V369K | + |
| 7405/7406 | L25Q/V263T/S317Y | +++ |
| 7407/7408 | E6P/I91Q/A212L/E288P/Q303V/V369K/V421I | + |
| 7409/7410 | I91Q/E288P/S317Y/V369K/V421I | ++ |
| 7411/7412 | L25Q/I91Q/A212L/E288P | + |
| 7413/7414 | A212L/E288P | + |
| 7415/7416 | I91Q/Q303V | +++ |
| 7417/7418 | I91Q/E288P/Q303V/S317Y/V369K | ++ |
| 7419/7420 | I91Q/S317Y | ++ |
| 7421/7422 | T5S/I91Q/E288P/Q303V | +++ |
| 7423/7424 | T5S/E6P/L25I/S317Y | ++ |
| 7425/7426 | I91Q/V263T/S317Y/V369K | ++ |

TABLE 73.1-continued

β1, 3GT Round 21 Combinatorial Variants and RebM Levels

| SEQ ID NO: (nt/aa) | Amino Acid Differences (Relative to SEQ ID NO: 6864) | Increased RebM[a] |
|---|---|---|
| 7427/7428 | I91Q/S317Y/V369K | + |
| 7429/7430 | T5S/D69A/I91Q/A212L/E288P | + |
| 7431/7432 | T5S/L25Q/I91Q/A212L/Q303V/S317Y | ++ |
| 7433/7434 | E6P/E288P | + |
| 7435/7436 | L25Q/I91Q/S317Y/V369K | + |

[a]Levels of increased production were determined relative to the reference polypeptide of SEQ ID NO: 6864, and defined as follows:
"+" = at least 1.12-fold, but less than 1.23-fold;
"++" = at least 1.23-fold, but less than 1.33-fold; and
"+++" = at least 1.33-fold increased production, as compared to the reference polypeptide.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.003-0.1 g/L SFP in 100 μL total reaction volumes of 50 mM potassium phosphate buffer, pH6, 15 mM stevioside (>95% purity) or rebaudioside D, 0.2 mM ADP (Amresco, ultra pure grade) co-substrate, 0.05 g/L SUS SFP SEQ ID NO: 2510, and 37.5 mM sucrose (cane sugar). The reactions were incubated in a Thermotron® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected in by SPE-QQQ as described in Example 31, Table 31.1. A further thermostability characterization was conducted with the clarified shake flask lysates prior to lyophilization as follows: lysates were diluted 400× in 50 mM potassium phosphate buffer, pH6, and incubated in a thermocycler at a gradient of 60-75° C. for 16 h. To determine the percent of activity remaining, the pre-incubated lysates were assayed as described above with either stevioside or rebaudioside D and 4h incubation at 60° C. The percent of activity remaining is expressed as production at the high temperature divided by production at the lowest pre-incubated temperature.

In these experiments, five variants in Table 73.2 produced more rebaudioside A from stevioside and more rebaudioside M from rebaudioside D at 60° C. than SEQ ID NO: 6864. SEQ ID NO: 7388 was selected as the best enzyme for the catalysis of glycosyltransfer from ADP-glucose to stevioside and rebaudioside D for the formation of rebaudioside A and rebaudioside M, respectively.

Example 74

Beta-1,3-ADP-Glycosyltransferase Variants of SEQ ID NO: 7388

In this Example, experiments for evolution and screening of β1,3-glycosyltransferase (β1,3GT) polypeptides derived from SEQ ID NO: 7388 for improved glucosylation of steviol glycosides using in situ synthesized ADP-glucose are described. Directed evolution of the GT encoded by SEQ ID NO: 7387 (i.e., SEQ ID NO: 7388) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide a twenty-second round ("Round 22") of 88 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared E. coli culture lysates expressing SEQ ID NO: 7387 variants. Pellets were lysed, and lysate was cleared as described in Example 60, and then diluted 20× into 50 mM potassium phosphate buffer, pH 6. In order to thermally challenge the lysates, they were pre-incubated at 75° C. in a Thermotron® titre-plate shaker with 300 RPM shaking for 1 h. Assays were conducted with 10 μL pre-incubated lysate in 100 μL reactions and with 20 g/L rebaudioside A 60% substrate, 0.05 g/L ADP (Amresco, ultra pure grade) co-substrate, 0.05 g/L SUS SFP SEQ ID NO: 2510, 0.08 g/L β-1,2-glycosyltransferase (β12GT) SEQ ID NO: 7324, and 40 g/L sucrose

TABLE 73.2

β1, 3GT Round 21 Shake Flask Powder Variants and RebA, RebM, and Thermostability Levels

| SEQ ID NO: (nt/aa) | Amino Acid Differences (Relative to SEQ ID NO: 6864) | Increased RebM, 60° C.[a] | Increased RebA, 60° C.[a] | % Activity Remaining[b] |
|---|---|---|---|---|
| 7369/7370 | M87K/M144Q | + | ++ | + |
| 7375/7376 | R88T/M144Q/Q159K | + | ++ | − |
| 7387/7388 | T5S/E6P/I91Q/E288P/S317Y | ++ | + | + |
| 7405/7406 | L25Q/V263T/S317Y | + | − | ++ |
| 7423/7424 | T5S/E6P/L25I/S317Y | − | − | + |
| 7431/7432 | T5S/L25Q/I91Q/A212L/Q303V/S317Y | − | − | ++ |

[a]Levels of increased production were determined relative to the reference polypeptide of SEQ ID NO: 6864, at 0.0125 g/L shake flask powder and defined as follows:
"−" = production less than that of the reference polypeptide;
"+" = production at least that of the reference polypeptide, but less than 1.15-fold;
"++" = at least 1.15-fold increased production, relative to reference polypeptide.
[b]The percent of activity remaining for each variant was determined following 24 h pre-incubation at 73.5° C., relative to the production from each variant following 24 h pre-incubation at 60° C. and is defined as follows:
"−" = less than 20% of activity remained following 16 h pre-incubation at 60° C.;
"+" = at least 20%, but less than 40% activity remained; and
"++" = at least 40% activity remained.

(cane sugar). The following reaction conditions were used: 50 mM potassium phosphate buffer, pH 6, 60° C. in a Thermotron® titre-plate shaker with 300 RPM shaking for 16 h. Reactions were solubilized by 20× dilution with water, quenched by 5× dilution with acetonitrile with 0.2% formic acid, and diluted 20× with water for analysis. Samples were analyzed by RapidFire-MS/MS as described in Example 31, Table 31.1. Glycosyltransferase variant polypeptides that produced rebaudioside M from rebaudioside A 60 with in situ synthesized ADP-glucose at greater quantities than SEQ ID NO: 7388 were identified. The engineered polypeptides are listed in Table 74.1 and Table 74.2. Shake-flask scale cultures were grown, lysed, cleared, and lyophilized to powder as described in Example 31 for analysis of variants shown in Table 74.3 relative to SEQ ID NO: 7388.

TABLE 74.1

β1, 3GT Round 22 Combinatorial Variants and RebM Levels

| SEQ ID NO: (nt/aa) | Amino Acid Differences (Relative to SEQ ID NO: 7388) | Increased RebM$^a$ |
|---|---|---|
| 7945/7946 | M87K/M144Q | + |
| 7947/7948 | K53E/W233Q/Q269R/V390I/V395I/Y396T | ++ |
| 7949/7950 | V9G/M144Q/K331R | + |
| 7951/7952 | M87K/M144Q/Y396T | ++ |
| 7953/7954 | K53E/M144Q/W233Q/Q269R/K331R/K428I | ++ |
| 7955/7956 | Q269R | ++ |
| 7957/7958 | R37S/W233S | + |
| 7959/7960 | M183L/W233Q/R234N/K331R/K428I | + |
| 7961/7962 | V9G/R37S/S113D/Y396T | ++ |
| 7963/7964 | V9G/M87K | + |
| 7965/7966 | R37S/S113D/M144Q/Y396T | + |
| 7967/7968 | Q269R/K428I/I437L | ++ |
| 7969/7970 | S113D/W233Q/R234N | + |
| 7971/7972 | W233Q/Y396T/N399Q | + |
| 7973/7974 | K53E/R234N | ++ |
| 7975/7976 | M144Q/R234N/Q269R | + |
| 7977/7978 | D134E/K222A/V263T | ++ |
| 7979/7980 | V263T | ++ |
| 7981/7982 | D69A/D134E | ++ |
| 7983/7984 | D69A/V263T/D434E/A438S/P439H | + |
| 7985/7986 | K171P/V263T | ++ |
| 7987/7988 | L322S | + |
| 7989/7990 | D69A/V263T | ++ |
| 7991/7992 | H81T | +++ |
| 7993/7994 | K222A/V263T/R435I/S442F | + |
| 7995/7996 | H81T/K222A/V263T/L322S/R435E/S442F | ++ |
| 7997/7998 | H81T/D134E | +++ |
| 7999/8000 | H81T/L433A/R435I/A438R/S442F | ++ |
| 8001/8002 | D69A | +++ |
| 8003/8004 | P2K/N3M/L433A/R435E/S442F | + |
| 8005/8006 | D69A/H81T | + |
| 8007/8008 | H81T/K222A | +++ |
| 8009/8010 | K222A | +++ |
| 8011/8012 | P2K/H81T | + |
| 8013/8014 | D69A/P439H | +++ |
| 8015/8016 | S61Q/L243I/D300A/R308L/V407I/R411T | + |
| 8017/8018 | C156S/Y165L/H248W/D300A/Q303V/R308L | ++ |
| 8019/8020 | L120V/C156S/Q159K/H248W/D300A/R308L | +++ |
| 8021/8022 | L120V/Q159K/Q197K/V365I/R411T | + |
| 8023/8024 | L120V/S253T/D300A/Q303V/R308L/V407I | + |
| 8025/8026 | S61Q/C156S/Q159K/L163A/Y165L/L243I/H248W/S253T/D300A/Q303V/R308L | ++ |
| 8027/8028 | R308L | + |
| 8029/8030 | A85V/C156S/Q159K/L243I/H248W/S253T/R308L/E405P/V407I/R411T | +++ |
| 8031/8032 | S61Q/L120V/C156S/L163A/Y165L/Q197K/Q303V/R308L | + |
| 8033/8034 | S61Q/C156S/Q197K/S253E | +++ |
| 8035/8036 | Q197K/D300A/R308L/R411T | ++ |
| 8037/8038 | Q159K/L163A/Y165L/Q197K/S214R/L243I/D300A/Q303V/R308L/V407I | + |
| 8039/8040 | C156S/S214R/R308L/R411T | +++ |

TABLE 74.1-continued

β1, 3GT Round 22 Combinatorial Variants and RebM Levels

| SEQ ID NO: (nt/aa) | Amino Acid Differences (Relative to SEQ ID NO: 7388) | Increased RebM$^a$ |
|---|---|---|
| 8041/8042 | S61Q/S214R | + |
| 8043/8044 | L120V/Q197K/R308L/V407I/R411T | ++ |
| 8045/8046 | S61Q/C156S/L163A/L243I/H248W/D300A/Q303V/R308L/V407I | +++ |
| 8047/8048 | S61Q/C156S/L163A/D300A/V365I/R411T | + |
| 8049/8050 | L120V/C156S/Q159K/E169D/Q197K/S214R/Q303V/R308L/V365I/E405P/V407I | ++ |
| 8051/8052 | L120V/R308L/V407I/R411T | + |
| 8053/8054 | C156S/H248W/S253T/R308L | +++ |
| 8055/8056 | L120V/C156S/H248W/Q303V/R308L/R411T | ++ |
| 8057/8058 | Q197K/S253T/R308L/V407I | + |
| 8059/8060 | S61Q/L120V/D300A/Q303V/V407I | +++ |
| 8061/8062 | L120V/Q159K/Y165L/Q197K | ++ |
| 8063/8064 | S61Q/V365I/E405P | + |
| 8065/8066 | L120V/Q197K/S253T/D300A/R308L | + |
| 8067/8068 | S61Q/S214R/D300A/R308L | + |
| 8069/8070 | L163A/Q197K/S253E/D300A/Q303V/R308L/V365I | + |
| 8071/8072 | L120V/Q159K | + |
| 8073/8074 | S61Q/L163A/D300A/Q303V/R308L/E405P/V407I/R411T | +++ |
| 8075/8076 | S61Q/Y165L/H248W/S253T/V407I/R411T | + |
| 8077/8078 | S61Q/D300A/Q303V/R308L | +++ |
| 8079/8080 | C156S/Q197K/H248W/D300A/R411T | ++ |
| 8081/8082 | D300A/Q303V/R308L | + |
| 8083/8084 | D300A/R308L/E405P/R411T | + |
| 8085/8086 | Q197K/D300A/Q303V/R308L/V365I | + |
| 8087/8088 | S61Q/L120V/Q159K/D300A/R308L/V407I | +++ |
| 8089/8090 | S61Q/D300A/Q303V/E405P | + |

$^a$Levels of increased production were determined relative to the reference polypeptide of SEQ ID NO: 7388, and defined as follows:
"+" = at least 1.19-fold, but less than 1.26-fold;
"++" = at least 1.26-fold, but less than 1.37-fold; and
"+++" = at least 1.37-fold increased production, as compared to the reference polypeptide.

TABLE 74.2

β1, 3GT Round 22 Saturation Mutagenesis Variants and RebM Levels

| SEQ ID NO: (nt/aa) | Amino Acid Differences (Relative to SEQ ID NO: 7388) | Increased RebM$^a$ |
|---|---|---|
| 8339/8340 | R76S | + |
| 8341/8342 | A107L | ++ |
| 8343/8344 | C338V | ++ |
| 8345/8346 | T72P | +++ |
| 8347/8348 | S61D | +++ |
| 8349/8350 | L56D | + |
| 8351/8352 | A107V | ++ |
| 8353/8354 | S61E | ++ |
| 8355/8356 | R88M | + |
| 8357/8358 | R88L | ++ |
| 8359/8360 | C156S | + |
| 8361/8362 | A41E | + |
| 8363/8364 | K139N | + |
| 8365/8366 | V407T | + |
| 8367/8368 | M87E | + |

$^a$Levels of increased production were determined relative to the reference polypeptide of SEQ ID NO: 7388, and defined as follows:
"+" = at least 1.04-fold, but less than 1.14-fold;
"++" = at least 1.14-fold, but less than 1.18-fold; and
"+++" = at least 1.18-fold increased production, as compared to the reference polypeptide.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.005-0.15 g/L SFP in 100 μL total reaction volumes of 50 mM potassium phosphate buffer, pH 6, 15 mM stevioside (>95% purity) or rebaudioside D, 0.1 g/L ADP (Amresco, ultra pure grade) co-substrate, 0.05 g/L SUS SFP SEQ ID NO: 2510, and 37.5 mM sucrose (cane sugar). The reactions were incubated in a Thermotron® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected in by SPE-QQQ as described in Example 31, Table 31.1. A further thermostability characterization was conducted with the clarified shake flask lysates prior to lyophilization as follows: lysates were diluted 20× in phosphate buffer and incubated in a thermocycler at a gradient of 60-75° C. for 24 h. To determine the percent of activity remaining, the pre-incubated lysates were assayed with 20 g/L rebaudioside A 60, 0.05 g/L ADP, 40 g/L sucrose, 0.05 g/L SUS SFP SEQ ID NO: 2510, and 0.08 g/L β1,2GT SFP SEQ ID NO: 7324, in 50 mM potassium phosphate buffer at pH 6, with 16 h incubation at 60° C. in a Thermotron® titre-plate shaker with 300 RPM shaking. Reactions were solubilized, quenched, and diluted as described for the high throughput assay. The percent activity remaining was expressed as production at the high temperature divided by production at the lowest pre-incubated temperature.

of rebaudioside A and rebaudioside M, respectively, because of its superior performance in the one-pot assay.

Example 75

Beta-1,3-ADP-Glycosyltransferase Variants of SEQ ID NO: 8088

In this Example, experiments for evolution and screening of β1,3-glycosyltransferase (β1,3GT) polypeptides derived from SEQ ID NO: 8088 for improved glucosylation of steviol glycosides using in situ synthesized ADP-glucose are described. Directed evolution of the GT encoded by SEQ ID NO: 8087 (i.e., SEQ ID NO: 8088) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide a twenty-third round ("Round 23") of 80 engineered GT variant polypeptides with glucosyltransferase activity toward ADP-glucose and steviol glycosides.

TABLE 74.3

β1, 3GT Round 22 Shake Flask Powder Variants and RebA, RebM from RebD, and RebM from RebA60, and Thermostability Levels

| SEQ ID NO: (nt/aa) | Amino Acid Differences (Relative to SEQ ID NO: 7388) | Increased RebM, 60° C.[a] | Increased RebA, 60° C.[a] | Increased RebM (from A60), 60° C.[a] | % Activity Remaining[b] |
|---|---|---|---|---|---|
| 7947/7948 | K53E/VV233Q/Q269R/ V390I/V395I/Y396T | + | + | ++ | − |
| 7949/7950 | V9G/M144Q/K331R | − | ++ | + | − |
| 7951/7952 | M87K/M144Q/Y396T | + | +++ | ++ | − |
| 7967/7968 | Q269R/K428I/I437L | + | − | + | − |
| 7977/7978 | D134E/K222A/V263T | + | + | ++ | + |
| 8007/8008 | H81T/K222A | ++ | ++ | ++ | + |
| 8029/8030 | A85V/C156S/Q159K/ L243I/H248W/S253T/ R308L/E405P/V407I/R411T | +++ | − | +++ | + |
| 8033/8034 | S61Q/C156S/ Q197K/S253E | ++ | ++ | ++ | ++ |
| 8039/8040 | C156S/S214R/ R308L/R411T | ++ | ++ | ++ | − |
| 8059/8060 | S61Q/L120V/D300A/ Q303V/V407I | + | + | + | + |
| 8087/8088 | S61Q/L120V/Q159K/ D300A/R308L/V407I | ++ | +++ | +++ | + |

[a]Levels of increased production were determined relative to the reference polypeptide of SEQ ID NO: 7388, at 0.019 g/L shake flask powder and defined as follows:
"−" = production less than that of the reference polypeptide;
"+" = production at least that of the reference polypeptide, but less than 1.21-fold;
"++" = at least 1.21-fold, but less than 1.45-fold; and
"+++" = at least 1.45-fold increased production, relative to the reference polypeptide.
[b]The percent of activity remaining for each variant was determined following 24 h pre-incubation at 73.5° C., relative to the production from each variant following 24 h pre-incubation at 60° C. and is defined as follows:
"−" = less than 33% of activity remained following 24 h pre-incubation at 60° C.
"+" = at least 33%, but less than 50% of the activity remained; and
"++" = at least 50% activity remained.

In these experiments, all eleven variants in Table 74.3 produced more rebaudioside M from rebaudioside A 60 than SEQ ID NO: 7388, and eight variants also produced more rebaudioside A from stevioside and rebaudioside M from rebaudioside D. SEQ ID NOS: 8034 and 8088 performed the best overall. SEQ ID NO: 8088 was selected as the best enzyme for the catalysis of glycosyltransfer from ADP-glucose to stevioside and rebaudioside D for the formation HTP Assay for Glucose Transfer from Sucrose to ADP and then from ADP-Glucose to Rebaudioside A 60

Assays were performed on 96-well plates of cleared E. coli culture lysates expressing SEQ ID NO: 8087 variants. Pellets were lysed, and lysate was cleared as described in Example 34, and then diluted 10× into 50 mM potassium phosphate buffer, pH 6. In order to thermally challenge the lysates, they were pre-incubated at 75° C. in a Thermotron® titre-plate shaker with 300 RPM shaking for 1 h. Assays were conducted with 10 μL pre-incubated lysate in 100 μL reactions and with 20 g/L rebaudioside A 60% substrate, 0.025 g/L ADP (Amresco, ultra pure grade) co-substrate, 0.05 g/L SUS SFP SEQ ID NO: 8420, 0.08 g/L β-1,2-glycosyltransferase (β12GT) SEQ ID NO: 7784, and 40 g/L sucrose (cane sugar). The following reaction conditions were used: 50 mM potassium phosphate buffer, pH 6, 60° C. in a Thermotron® titre-plate shaker with 300 RPM shaking for 16 h. Reactions were solubilized by 20× dilution with water, quenched by 5× dilution with acetonitrile with 0.2% formic acid, and diluted 20× with water for analysis. Samples were analyzed by RapidFire-MS/MS as described in Example 31, Table 31.1. Glycosyltransferase variant polypeptides that produced rebaudioside M from rebaudioside A 60 with in situ synthesized ADP-glucose at greater quantities than SEQ ID NO: 8088 were identified. The engineered polypeptides are listed in Table 75.1 and Table 75.2. Shake-flask scale cultures were grown, lysed, cleared, and lyophilized to powder as described in Example 1 for analysis of variants shown in Table 75.3 relative to SEQ ID NO: 8088.

TABLE 75.1

β1, 3GT Round 23 Combinatorial Variants and RebM Levels

| SEQ ID NO: (nt/aa) | Amino Acid Differences (Relative to SEQ ID NO: 8088) | Increased RebM$^a$ |
|---|---|---|
| 8481/8482 | M87K/Q91L/V120L/W233Q | + |
| 8483/8484 | M87K/Q91L/K94C/V263T/E389L | + |
| 8485/8486 | M87A/Q91L/K94C/W233Q/E259T | + |
| 8487/8488 | M87K/Q91L/K94C | + |
| 8489/8490 | Q91L/K94C/W233Q/E259T | + |
| 8491/8492 | M87A/Q91L/V120L/W233Q | + |
| 8493/8494 | M87K/Q91L/W233Q | + |
| 8495/8496 | Q91L/V120L | ++ |
| 8497/8498 | W233Q/E259T/E389L | +++ |
| 8499/8500 | Q91L/W233Q | ++ |
| 8501/8502 | V263T/E389L | + |
| 8503/8504 | Q91L/W233Q/E389L | +++ |
| 8505/8506 | K94C/W233Q/R411T | +++ |
| 8507/8508 | M87A/R435E | ++ |
| 8509/8510 | Q91L/W233Q/E259T/E389L | ++ |
| 8511/8512 | L163A/W233Q | + |
| 8513/8514 | M87K/Q91L/K94C/V120L | + |
| 8515/8516 | M87A/K94C | ++ |
| 8517/8518 | M87A | +++ |
| 8519/8520 | M87A/Q91L/L163A | ++ |
| 8521/8522 | W233Q/A438S | + |
| 8523/8524 | E259T | + |
| 8525/8526 | M87A/Q91L/K94C/W233Q | ++ |
| 8527/8528 | W233Q/E259T/V263T | ++ |
| 8529/8530 | Q91L/V120L/W233Q | + |
| 8531/8532 | M87A/K4281/D431M/R435E | ++ |
| 8533/8534 | V263T | +++ |
| 8535/8536 | L322S | + |
| 8537/8538 | M87A/Q91L/V120L/W233Q/R411T/D431M/R435E/I437L | ++ |
| 8539/8540 | M87K/Q91L/L163A/W233Q/V263T | +++ |
| 8541/8542 | Q91L/K94C/V120L/W233Q/E389L/D431M/A438S | + |
| 8543/8544 | M87A/Q91L/E259T/V263T/E389L/K4281/D431M/R4351/I437L | +++ |
| 8545/8546 | M144Q/E389L | + |
| 8547/8548 | M87A/W233Q/L322S/E389L/R411T | + |
| 8549/8550 | M87K/K94C/M144Q/V263T/K428I/R435E | +++ |
| 8551/8552 | Q91L/K94C | ++ |
| 8553/8554 | M87K/Q91L | + |
| 8555/8556 | E389L | ++ |
| 8557/8558 | M87K | +++ |
| 8559/8560 | Q91L/K94C/V120L/W233Q | ++ |
| 8561/8562 | W233Q | +++ |
| 8563/8564 | K4281/D431M/R435E | ++ |
| 8565/8566 | M87A/Q91L/L322S | + |
| 8567/8568 | M87K/Q91L/V263T/E389L | ++ |
| 8569/8570 | Q91L | ++ |
| 8571/8572 | M87A/W233Q/E389L | +++ |
| 8573/8574 | M87K/L163A/W233Q | ++ |
| 8575/8576 | M87A/Q91L/L163A/E389L | ++ |
| 8577/8578 | M87A/W233Q | +++ |
| 8579/8580 | M87K/Q91L/K94C/W233Q | + |
| 8581/8582 | M87K/Q91L/E389L | +++ |
| 8583/8584 | M87A/Q91L | ++ |
| 8585/8586 | M87A/Q91L/W233Q | +++ |
| 8587/8588 | M87K/Q91L/L163A/W233Q | ++ |
| 8589/8590 | M87A/E259T | + |
| 8591/8592 | M87A/K94C/V263T | + |
| 8593/8594 | M87K/Q91L/M144Q/E259T | + |
| 8595/8596 | M87A/Q91L/W233Q/E389L | + |
| 8597/8598 | M87A/V263T | + |

TABLE 75.1-continued

β1, 3GT Round 23 Combinatorial Variants and RebM Levels

| SEQ ID NO: (nt/aa) | Amino Acid Differences (Relative to SEQ ID NO: 8088) | Increased RebM[a] |
|---|---|---|
| 8599/8600 | M87A/VV233Q/E259T | + |
| 8601/8602 | T72P/R76S/A107L/C156S | + |
| 8603/8604 | K53E/H81T/H195Q/Q197K | + |
| 8605/8606 | D69A/T72P/R76S/A107L | + |
| 8607/8608 | R37S/T72P/H195Q/K331R | + |
| 8609/8610 | H195Q/Q197K | + |
| 8611/8612 | T72P/R76S/A107L/H195Q/Q197K | + |
| 8613/8614 | R37S/T72P/R76S/H81T | + |
| 8615/8616 | T72P/Q269R | + |
| 8617/8618 | Q197K | + |
| 8619/8620 | R37S/T72P/R76S/A107L/C156S/K331R | + |
| 8621/8622 | H81T/A107L/H195Q | + |

[a]Levels of increased production were determined relative to the reference polypeptide of SEQ ID NO: 8088, and defined as follows:
"+" = at least 1.3-fold, but less than 1.55-fold;
"++" = at least 1.55-fold, but less than 1.8-fold; and
"+++" = at least 1.8-fold increased production, as compared to the reference polypeptide.

TABLE 75.2

β1, 3GT Round 23 Saturation Mutagenesis Variants and RebM Levels

| SEQ ID NO: (nt/aa) | Amino Acid Differences (Relative to SEQ ID NO: 8088) | Increased RebM[a] |
|---|---|---|
| 9223/9224 | P324D | + |
| 9225/9226 | V413L | + |
| 9227/9228 | V451Q | ++ |
| 9229/9230 | P324G | + |
| 9231/9232 | S252P | + |
| 9233/9234 | S111T | + |
| 9235/9236 | S255T | + |
| 9237/9238 | L328T | + |
| 9239/9240 | S55G | + |

[a]Levels of increased production were determined relative to the reference polypeptide of SEQ ID NO: 8088, and defined as follows:
"+" = at least 1.05-fold, but less than 1.2-fold; and
"++" = at least 1.2-fold increased production, as compared to the reference polypeptide.

SFP Characterization Assay and Analysis for Glucosyl Transfer from Sucrose to ADP and then from ADP-Glucose to Stevioside and Rebaudioside D Shake flask powders (SFP) were constituted to a concentration of 20 g/L and diluted to 0.005-0.15 g/L SFP in 100 µL total reaction volumes of 50 mM potassium phosphate buffer, pH6, 15 mM stevioside (>95% purity) or rebaudioside D, 0.1 g/L ADP (Amresco, ultra pure grade) co-substrate, 0.05 g/L SUS SFP SEQ ID NO: 8420, and 37.5 m sucrose (cane sugar). The reactions were incubated in a Thermotron® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected in by SPE-QQQ as described in Example 31, Table 31.1. A one-pot reaction was conducted with 0.01-0.3 g/L SFP in 100 µL total reaction volumes of 50 mM potassium phosphate buffer, pH6, 20 µL RebA60, 0.025 g/L ADP (Amresco, ultra pure grade) co-substrate, 0.05 g/L SUS SFP SEQ ID NO:8420, 0.12 g/L β1,2GT SFP SEQ ID NO:7784, and 40 g/L sucrose (cane sugar). The reactions were incubated in a Thermotron® titre-plate shaker with 300 RPM shaking for 16 hours at 60° C. The reactions were solubilized by 20× dilution with water, quenched by 5× dilution with acetonitrile with 0.2% formic acid, cleared by centrifugation, and diluted 20× with water for analysis.

TABLE 75.3

β1, 3GT Round 23 Shake Flask Powder Variants and RebA, RebM from RebD, and RebM from RebA60, and Thermostability Levels

| SEQ ID NO: (nt/aa) | Amino Acid Differences (Relative to SEQ ID NO: 8088) | Increased RebM, 60° C.[a] | Increased RebA, 60° C.[a] | Increased RebM (from A60), 60° C.[a] |
|---|---|---|---|---|
| 8491/8492 | M87A/Q91L/V120L/W233Q | ++ | + | ++ |
| 8503/8504 | Q91L/W233Q/E389L | + | + | ++ |
| 8571/8572 | M87A/W233Q/E389L | + | ++ | + |
| 8597/8598 | M87A/V263T | ++ | + | ++ |
| 8611/8612 | T72P/R76S/A107L/H195Q/Q197K | ++ | − | +++ |
| 8621/8622 | H81T/A107L/H195Q | + | − | ++ |

[a]Levels of increased production were determined relative to the reference polypeptide of SEQ ID NO: 8088, at 0.019 g/L shake flask powder and defined as follows:
"−" = production less than that of the reference polypeptide;
"+" = production at least that of the reference polypeptide, but less than 1.1-fold;
"++" = at least 1.1-fold, but less than 1.25-fold; and
"+++" = at least 1.25-fold increased production, relative to reference polypeptide.

In these experiments, all eleven variants in Table 75.3 produced more rebaudioside M from rebaudioside A 60 than SEQ ID NO: 8088, and eight variants also produced more rebaudioside A from stevioside and rebaudioside M from rebaudioside D. SEQ ID NO: 8598 was selected as the best enzyme for the catalysis of glycosyltransfer from ADP-glucose to stevioside and rebaudioside D for the formation of rebaudioside A and rebaudioside M, respectively, because of its superior performance in the one-pot assay.

Example 76

Thermal Tolerance of Engineered Glycosyltransferases and Recycling Enzyme

Three assays were performed to determine the thermal tolerance of an engineered β-1,3-glycosyltransferase (β1,3GT, SEQ ID NO: 6864), β-1,2-glycosyltransferase (β1,2GT, SEQ ID NO: 4550), and sucrose synthase recycling enzyme (SUS, SEQ ID NO: 2510) using shake flask powders (SFP).

First, a multi-day stability assay at 60° C. was performed by diluting each enzyme SFP in 50 mM potassium phosphate pH 6 (β1,3GT, 0.5 g/L; β1,2GT, 0.25 g/L; SUS, 0.1 g/L) and incubating for variable times from 0-48 h prior to assaying. The amount of activity remaining was determined by assaying under the conditions described in this Example. For β1,3GT, 10 μL of the 0-48 h pre-incubated shake flask powder was used in 100 μL total reaction volumes of 50 mM potassium phosphate buffer, pH 6, 15 mM stevioside (>95% purity) or rebaudioside D, 0.2 mM ADP (Amresco, ultra pure grade) co-substrate, 0.05 g/L SUS SFP SEQ ID NO: 2432, and 37.5 mM sucrose (cane sugar). The reactions were incubated in a Thermotron® titre-plate shaker with 300 RPM shaking for 4 hours at 60° C., then solubilized by 20× dilution with water, quenched by 5× dilution into acetonitrile with 0.2% formic acid, cleared by centrifugation, and diluted 15× with water for analysis by SPE-QQQ as described in Example 31, Table 31.1. At 28 h, 60% of the un-preincubated activity for rebaudioside D to rebaudioside M remained, and at 48 h, 39% activity remained; for stevioside to rebaudioside A, 34% remained after 28 h and 19% remained after 48. Thus, the β1,3GT SEQ ID NO: 6864 has a half-life of 20-40 h at 60° C. For β1,2GT, the assay was performed similarly with 20 mM rebaudioside A (>97% purity) and 50 mM sucrose. At 24 h, 50-74% of the un-preincubated activity remained, and at 46 h, 33% of the activity remained. Thus, the β1,2GT SEQ ID NO: 4550 has a half-life of 29-58 h at 60° C. For SUS, the assay was performed similarly with 15 mM rebaudioside A (>97% purity), 37.5 mM sucrose, 9 mM fructose, and 0.5 g/L β1,2GT SEQ ID NO: 4550 as the coupled enzyme. At 24 h, 89% of the un-pre-incubated activity remained, and at 48 h, 86% of the activity remained. Thus, the SUS SEQ ID NO: 2510 has a half-life of >100 h at 60° C. All three of these half-lives at 60° C. represent a large difference from wild-type enzymes, which do not have significant stability above ambient temperature.

Second, identical stocks of each of the three enzymes were preincubated for 24 h across a temperature gradient of 60-69.1° C. (SUS), 59.9-79.9° C. (β1,2GT), or 59.7-75.1° C. in a thermocycler, and enzymes were assayed as described above to determine the activity remaining relative to the lowest pre-incubation temperature (~60° C. for all three). For β1,3GT, 20% of the activity was retained following pre-incubation at 73.5° C. relative to preincubation at 59.7° C. For β1,2GT, 17% of the activity was retained following pre-incubation at 73.6° C. For SUS, 85% of the activity was retained following pre-incubation at 69.1° C. Stability at 24 h up to temperatures >70° C. allows for a wide range of fermentation downstream processing temperatures and for a wide range of steviol glycoside conversion temperatures. By heating the steviol glycoside conversion reaction, the risk of microbial contamination is reduced and steviol glycoside substrate and product solubilities are enhanced, increasing the rate of conversion. Additionally, the intrinsic reaction rate is slightly increased by increasing temperature.

Third, β1,3GT, 0.1 g/L; β1,2GT, 0.025 g/L; and SUS, 0.01 g/L were assayed in single substrate conversion assays as described above without pre-incubation with incubation at 55-65° C. to determine whether the enzymes would be robust in this temperature range. For all three enzymes, there was <36% increase or decrease in the conversion measured after 4 h at 65° C. relative to 55° C.

Example 77

Assay of Engineered Glycosyltransferases and Recycling Enzyme with Additional NDPs and NDP-Glucoses Multiple nucleoside diphosphates (NDPs) and nucleoside diphosphate-glucoses (NDP-glucoses) can be used with the engineered glycosyltransferases and recycling system.

To determine the promiscuity of the engineered β-1,3-glycosyltransferase (β1,3GT, SEQ ID NO: 6864) and β-1,2-glycosyltransferase (β1,2GT, SEQ ID NO: 4550) for alternate NDP-glucose donors, three commercially available NDP-glucoses were tested: ADP-glucose (Amresco, ultra high grade), GDP-glucose (Sigma, >97% purity), and TDP-glucose (Carbosynth, >95% purity) with enzyme shake flask powders (SFP). For β1,3GT, the reactions were carried out with 0.025 g/L SFP in 1 mM stevioside (>95% purity), 1 mM NDP-glucose, 50 mM potassium phosphate buffer, pH 6. At 1, 2, and 3 h, the reactions were solubilized by 4× dilution in water, quenched by 5× dilution in acetonitrile with 0.2% formic acid, and diluted 5× in water for analysis. For β1,2GT, the reactions were carried out with 0.0025 g/L SFP in 1 mM rebaudioside A (>97% purity), but were otherwise identical to the method described above. The results are summarized in Table 68.1 as the percent (%) conversion of steviol glycoside substrate in the first hour.

TABLE 77.1

| NDP-Glucose Utilization by Engineered Glycosyltransferases | | | |
|---|---|---|---|
| SEQ ID NO: (nt/aa) | ADP-Glucose[a] | GDP-Glucose[a] | TDP-Glucose[a] |
| 4550 | ++++ | +++ | ++ |
| 6864 | + | + | − |

[a]Levels of NDP-glucose utilization were determined as mmol steviol glycoside converted per gram shake flask powder and defined as follows:
"−" = activity less than 10 mmol/g;
"+" = activity between 10 and 30 mmol/g;
"++" = activity between 30 and 50 mmol/g;
"+++" = activity between 50 and 70 mmol/g; and
"++++" = at least 70 mmol/g activity.

To determine the promiscuity of the engineered β-1,2-glycosyltransferase (β1,2GT, SEQ ID NO:4550) and sucrose synthase recycling enzyme (SUS, SEQ ID NO:2510) for alternate NDP co-factors, four commercially available NDPs were tested: ADP (Sigma, >95%), CDP (Sigma, >95%), GDP (Sigma, >96%), IDP (Sigma, >96%). The reactions were carried out with 0.001 g/L SUS SFP and 0.1 g/L β1,2GT SFP in 10 mM rebaudioside A (>97% purity), 0.2 mM NDP, 50 mM potassium phosphate buffer, pH6. At 1, 2, and 3h, the reactions were solubilized by 40× dilution in water, quenched by 5× dilution in acetonitrile with 0.2% formic acid, and diluted 5× in water for analysis. A second sucrose synthase (SEQ ID NO: 72) was also tested, using 10 µL of purified protein glycerol stock in the 100 reaction. The results are summarized in Table 77.2 as NDP turnovers (mmol rebaudioside D/mmol cofactor) in the first hour. As these data indicate the use of ADP/ADP-glucose provides useful reaction conditions. In addition, these compounds are beneficial from an economic perspective, as compared to other options (e.g., UDP/UDP-glucose).

TABLE 77.2

NDP Utilization by Engineered Glycosyltransferase and Recycling Enzyme

| SEQ ID NO: (nt/aa) | ADP[a] | CDP[a] | GDP[a] | IDP[a] |
|---|---|---|---|---|
| 2510 | +++ | − | − | − |
| 72 | ++ | − | + | + |

[a]Levels of NDP utilization were determined as mmol steviol glycoside converted per mmol cofactor in 1 h and defined as follows:
"−" = activity less than 1;
"+" = between 1 and 2;
"++" = between 2 and 3; and
"+++" = greater than 3 cofactor turnovers.

Example 78

Process to Convert Rebaudioside A 60% to Rebaudioside M

Reb A 60 (~1:2 mixture of stevioside and rebaudioside A [reb A] by mass) has unexpectedly high solubility in water and sucrose solutions. The individual aqueous solubility of stevioside and Reb A is reported to be in the range of 3-5 g/L. Surprisingly, 100-200 g/L solutions of Reb A 60 were prepared either in water or in 200 g/L of sucrose and no precipitate developed in said solutions upon standing at room temperature for one week. Remarkably, during the course of the reactions, both the Reb D intermediate and the Reb M product remained soluble (as evident by the homogenous reaction mixture) at levels (ca. 30-50 g/L) far exceeding their reported solubility limits (~0.3-0.5 and 3-5 g/L, respectively). The efficiency of the process was greatly enhanced by the unpredictably high solubility of the Reb A 60 starting material and the Reb D intermediate.

A process to convert Reb A 60 to rebaudioside M was developed with an engineered β-1,3-glycosyltransferase (β1,3GT, SEQ ID NO: 6138), β-1,2-glycosyltransferase (β1,2GT, SEQ ID NO: 3696), and sucrose synthase (SUS, SEQ ID NO: 1846). A recycling stock solution was prepared, consisting of 0.2 g/L SUS, 0.1 g/L ADP, and 200 g/L sucrose in 50 mM pH 6, potassium phosphate buffer. β1,2GT was dissolved in this solution to 1.6 g/L, and a separate stock of β1,3GT was dissolved in the recycling stock solution to 2.0 g/L. Then, 100 mg of Reb A 60 was placed in a one dram vial and 0.5 mL each of the 1.6 g/L β1,2GT stock and 2.0 g/L β1,3GT stock were added. The resulting homogenous solution was stirred at 55° C. Precipitate gradually developed and at 24 h the reaction mixture was a thick white slurry. HPLC analysis showed the presence of 90-94% Reb M (~120-130 g/L Reb M).

In another experiment, the above reaction was carried out in the presence of 0.5 g/L of ADP and 10 mM of EDTA. Under these conditions, the β1,2GT and β1,3GT loadings were both decreased to 0.4 g/L, while still reaching >90% conversion to Reb M. When the lyophilized enzyme powders were produced at 10-15 L scale fermentation and processed downstream with 60° C. heat treatment and ultrafiltration, 95% of the stevioside and rebaudioside A in Reb A 60 were converted to rebaudioside M under certain ratios of β1,2GT stock to β1,3GT stock.

A process to convert Reb A 60 to rebaudioside M was developed with another set of engineered β-1,3-glycosyltransferase (β1,3GT, SEQ ID NO: 6864), β-1,2-glycosyltransferase (β1,2GT, SEQ ID NO: 4550), and sucrose synthase (SUS, SEQ ID NO: 2510) enzymes. A recycling stock solution was prepared, consisting of 0.2 g/L of SUS, 0.5 g/L of ADP and 200 g/L of sucrose in 50 mM pH 6, potassium phosphate buffer with 10 mM of EDTA. β1,2GT was dissolved in this solution to 0.6 g/L, and a separate stock of β1,3GT was dissolved in the recycling stock solution to 1.2 g/L. Then, 100 mg of Reb A 60 was placed in a one dram vial and 0.5 mL each of the 0.6 g/L β1,2GT stock and 1.2 g/L β1,3GT stock were added. The resulting homogenous solution was stirred at 60° C. Precipitate gradually developed and at 24 h the reaction mixture was a thick white slurry. HPLC analysis showed the presence of 90-92% Reb M (~120-130 g/L Reb M). This reaction was scaled to 2 grams Reb A 60 in 20 mL with 0.6 g/L β1,2GT, 0.2 g/L SUS, and 1.2 g/L β1,3GT with 0.5 g/L ADP and 10 mM EDTA at 60° C., and it was determined that 87.1% RebM was obtained by area under curve using JECFA method. For purification, the reaction mix was centrifuged at 40° C., the supernatant was decanted, and the pellet was resuspended with 1 volume deionized water, centrifuged at 20° C., and the supernatant was decanted. This wash was repeated for four total washes and the pellet was lyophilized, yielding 94.3% RebM as determined by area under curve using JECFA method.

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention.

SEQUENCE LISTING (9240 sequences)

SEQ ID NO: 1 - DNA, 1326 bp, Artificial Sequence
  UGT76G1 wild type
atggaaaataaaacggagaccaccgttcgccggcgccggagaataatattattcccggtaccatttcaaggccacattaacccaattcttcagctagccaatgtgttgtactctaaaggattcagtatcaccatctttcacaccaacttcaacaaacccaaaacatctaattaccctcacttcactttcagattcatcctcgacaacgacccacaagacgaacgcatttccaatctaccgactcatggtccgctcgctggtatgcggattccgattatcaacgaacacggagctgacgaattacgacgcgaactggaactgttgatgttagcttctgaagaagatgaagaggtatcgtgtttaatcacggatgctctttggtacttcgcgcaatctgttgctgacagtcttaacctccgacggcttgttttgatgacaagcagcttgtttaattttcatgcacatgtttcacttcctcagtttgatgagcttggttacctcgatcctgatgacaaaacccgtttggaagaacaagcgagtgggtttcctatgctaaaagtgaaagacatcaagtctgcgtattcgaactggcaaatactcaaagagatattagggaagatgataaaacaaacaagagcatcttcaggagtcatctggaactcatttaaggaactcgaagagtctgagctcgaaactgttatccgtgagatcccggctccaagtttcttgataccactccccaagcatttgacagcctcttccagcagcttactagaccacgatcgaaccgtttttcaatggttagaccaacaaccgccaagttcggtactgtatgttagttttggtagtactagtgaagtggatgagaaagatttcttggaaatagctcgtgggttggttgatagcaagcagtcgtttttatgggtggttcgacctgggtttgtcaagggttcgacgtgggtcgaaccgttgccagatgggttcttgggtgaaagaggacgtattgtgaaatgggttccacagcaagaagtgctagctcatggagcaataggcgcattctggactcatagcggatggaactctacgttggaaagcgtttgtgaaggtgttcctatgattttctcggattttgggctcgatcaaccgttgaatgctagatacatgagtgatgttttgaaggtaggggtgtatttggaaaatgggtgggaaagaggagagatagcaaatgcaataagaagagttatggtggatgaagaaggagaatacattagacagaatgcaagagttttgaaacaaaaggcagatgtttctttgatgaagggtggt

SEQ ID NO: 2 - protein, 442 aa, Artificial Sequence
  UGT76G1 wild type
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGG

SEQ ID NO: 3 - DNA, 1374 bp, Artificial Sequence
  Codon optimized UGT76G1
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtgggtggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 4 - protein, 458 aa, Artificial Sequence
  UGT76G1 wild type
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 5 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 6 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 7 - DNA, 1371 bp, Artificial Sequence
  UGT76G1 Variant
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 8 - protein, 457 aa, Artificial Sequence
  UGT76G1 Variant
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 9 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtatgttagctttggcagcaccagcgaggtggacgaaaaggatttcctggagattgcgcgtggtctggttgacagcaaacaaagctttctgtgggtggttcgtccgggcttcgtgaagggtagcacctgggttgagccgctgccggatggttttctgggcgaacgtggtcgtatcgtgaagtgggtgccgcaacaagaagttctggcgcacggcgcgattggtgcgttctggacccacagcggttggaatggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 10 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 11 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagtgttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 12 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWSVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 13 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtatgttagctttggcagcaccagcgaggtggacgaaaaggatttcctggagattgcgcgtggtctggttgacagcaaacaaagctttgtgtgggtggttcgtccgggcttcgtgaagggtagcacctgggttgagccgctgccggatggttttctgggcgaacgtggtcgtatcgtgaagtgggtgccgcaacaagaagttctggcgcacggcgcgattggtgcgttctggacccacagcggttggaatagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 14 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFVWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 15 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcacgaccagcgaggtggacgaaaaggatttcctggagattgcgcgtggtctggttgacagcaaacaaagctttctgtgggtggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 16 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGTTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 17 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggttggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 18 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWLVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 19 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgttggttagctttggcagcataagcgaggtggacgaaaaggatttcctggagattgcgcgtggtctggttgacagcaaacaaagctttctgtgggtggttggtccgggcttcgtgaagggtagcacctgggttgagccgctgccggatggttttctgggcgaacgtggtcgtatcgtgaagtgggcgccgcaacaagaagttctggcgcacggcgcgattggtgcgttctggacccacagcggttggggtagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 20 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLLVSFGSISEVDEKDFLEIARGLVDSKQSFLWVVGPGFVKGSTWVEPLPDGFLGERGRIVKWAPQQEVLAHGAIGAFWTHSGWGSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 21 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggaatgttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 22 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWNVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 23 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatctgaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtgggtggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 24 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDLTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 25 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtatgttagctttggcagcaccagcgaggtggacgaaaaggatttcctggagattgcgcgtggtctggttgacagcaaacaaagctttctgtgggtggttcgtccgggcttcgtgaagggtagcacctgggttgagccgctgccggatggttttctgggcgaacgtggtcgtatcgtgaagtgggcgccgcaacaagaagttctggcgcacggcgcgattggtgcgttctggacccacagcggttggaatggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 26 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWAPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 27 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtatgttagctttggcagcaccagcgaggtggacgaaaaggatttcctggagattgcgcgtggtctggttgacagcaaacaaagctttctgtgggtggttcgtccgggcttcgtgaagggtagcacctgggttgagccgctgccggatggttttctgggcgaacgtggtcgtatcgtgaagtgggtgccgcaacaagaaattctggcgcacggcgcgattggtgcgttctggacccacagcggttggaatggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 28 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEILAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 29 - DNA, 1374 bp, Artificial Sequence
  UGT76G1 Variant
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgataagaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtgggtggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 30 - protein, 458 aa, Artificial Sequence
  UGT76G1 Variant
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDKTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 31 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 32 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 33 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagctcggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaagccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggagggttcgtccgggcttcgtgaagggtagcgagtgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 34 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASSEDEEVSCLITDALWYFAQSVADSLNLRRLVLMTSSLFNFHAHVSLPQFDELGYLDPDDKSRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 35 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 36 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 37 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 38 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSTWVEPLPDGFLGERGRIVKWVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 39 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggagcgttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 40 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWSVRPGFVKGSTWVEPLPDGFLGERGRIVKWVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 41 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaagaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcacccagagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaaggaaaaagcggatgttagcctgatgaagggtggcagcagctacgagagcctggaaagcctggttagctatattagcagcctg

SEQ ID NO: 42 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGTQSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKEKADVSLMKGGSSYESLESLVSYISSL

SEQ ID NO: 43 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaaactgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 44 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLKLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 45 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagggttcgtccgggcttcgtgaagggtagcgagtgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 46 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWRVRPGFVKGSEWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 47 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagctcggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatagcaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagggttcgtccgggcttcgtgaagggtagcgagtgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 48 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASSEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDSTVFQWLDQQPPSSVLYVSFGSTSEVDEKDFLEIARGLVDSKQSFLWRVRPGFVKGSEWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 49 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaaactgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaaggaaaaagcggatgttagcctgatgaagggtggcagcagctacgagagcctggaaagcctggttagctatattagcagcctg

SEQ ID NO: 50 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLKLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKEKADVSLMKGGSSYESLESLVSYISSL

SEQ ID NO: 51 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgcaccgtgttccagtggctggaccagcaaccgccgagcagcgtgctgtacgttagctttggcacccagagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 52 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGTQSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 53 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaagaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagaaaggctacctggatccggacgataaaacccgtctggaggaacaagcgagcggattcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagggttcgtccgggcttcgtgaagggtagcgagtgggttgagccgctgccggatggttttctgggtgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 54 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDEKGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWRVRPGFVKGSEWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 55 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcacctgggttgagccgctgccggatggttttctgggcgaacgtggtcgtatcgtgaagtctgttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgtgcgtgttctgaagcaaaaagcggatgttagcctgatgaagggtggcagcagctacgagagcctggaaagcctggttagctatattagcagcctg

SEQ ID NO: 56 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSTWVEPLPDGFLGERGRIVKSVPQQEVLAHGAIGAFWTHSGWNSTLESVCEGVPMIFSDFGLDQPLNARYMSDVLKVGVYLENGWERGEIANAIRRVMVDEEGEYIRQNVRVLKQKADVSLMKGGSSYESLESLVSYISSL

SEQ ID NO: 57 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatagcaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtttgttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 58 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDSTVFQWLDQQPPSSVLYVSFGSQSEVDEKDFLEIARGLVDSKQSFLWRVRPGFVKGSTWVEPLPDGFLGERGRIVKFVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 59 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagctcggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcacccagagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaaggaaaaagcggatgttagcctgatgaagggtggcagcagctacgagagcctggaaagcctggttagctatattagcagcctg

SEQ ID NO: 60 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASSEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGTQSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKEKADVSLMKGGSSYESLESLVSYISSL

SEQ ID NO: 61 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatagcaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtctgttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 62 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDSTVFQWLDQQPPSSVLYVSFGSTSEVDEKDFLEIARGLVDSKQSFLWRVRPGFVKGSTWVEPLPDGFLGERGRIVKSVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 63 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaagaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaaggaaaaagcggatgttagcctgatgaagggtggcagcagctacgagagcctggaaagcctggttagctatattagcagcctg

SEQ ID NO: 64 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWRVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKEKADVSLMKGGSSYESLESLVSYISSL

SEQ ID NO: 65 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtggagggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 66 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWRVRPGFVKGSTWVEPLPDGFLGERGRIVKWVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 67 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaagaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggattcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccaatggctggacacgcaaccgccgagcagcgtgctgtacgttagctttggcagcaccagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggtgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 68 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDTQPPSSVLYVSFGSTSEVDEKDFLEIARGLVDSKQSFLWRVRPGFVKGSEWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 69 - DNA, 1371 bp, Artificial Sequence
  ADP-Glycosyltransferase variant of SEQ ID NO: 7
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatagcaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcacctgggttgagccgctgccggatggttttctgggcgaacgtggtcgtatcgtgaagtttgttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 70 - protein, 457 aa, Artificial Sequence
  ADP-Glycosyltransferase variant of SEQ ID NO: 7
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDSTVFQWLDQQPPSSVLYVSFGSQSEVDEKDFLEIARGLVDSKQSFVWRVRPGFVKGSTWVEPLPDGFLGERGRIVKFVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 71 - DNA, 2460 bp, Artificial Sequence
  Codon optimized Thermosynechococcus elongatus sucrose synthase
atgcaccatcatcatcatcatggcggtagcggcatgacttgtgttctgttaaaagcagttgtagaaagcgacgaacgtgccgacctgcgccagttttcacgcattctgcaactgggcgaaaaacgctacctgctgcgcaacgacattctggatgcgtttgcagactattgccgcgatcaagaacgcccggtgccaccaccgagcgaaagccgtctgagcaaactggtcttctatacccaggaaattatcgtggataacgaatcactgtgttggatcgttcgtccacgtattgcacagcaggaagtgtgccgtttactggtcgaagacctgaccattgtgccgatgaccatcccggagctgctggatctgcgtgaccgcttggtgaaccattatcatccgaacgaaggcgacgtgtttgagattgatgtgcaaccgttttatgactatagcccaatcatccgtgatgcgaaaaacatcggtaagggcgtcgagttcctgaaccgctatcttagctcgaagctgttccaggacccgcgccaatggcaacagaacctgttcaacttcctgcgcattcatcgctacaatggctaccagctgctgattaacgagcgcattcgtagtccgcagcatctgagcgaacaggtcaaacaagcactggttgtgctgagcgatcgtccaccaactgaagcctatagcgagtttcgcttcgagctgcaaaacctgggttttgaaccaggttggggcaataccgttgcacgtgttcgtgacaccctggaaattctggaccagctgctggatagcccggaccatcaagttctggaagcgtttgtgagccgcatcccaatgctgttccgcattgcactgatttcgccgcatggttggttcggtcaggaaggtgttctgggtcgtccagatacgggtggtcaggttgtgtatatcctggaccaggtgaagagtctggagaaacagatgcgcgaagaccttgaactggccggtttaggcgttctggaagcacagccgaagatcatcgttctgacccgcctcattccaaatgcggaaggcaccctgtgtaaccaacgtctggaaaagatttacggcaccaatgatgcgtggattctgcgcgttccatttcgcgagttcaacccgaaagtcacgcagaattggattagccgctttgagatctggccgtacctggaaacctttgcgattgacgccgaacgtgaactgcgtgcagaatttggtcatgtaccggatctgatcatcggcaattatagcgacggtaatttggttgcgttcctgttagcgcgtcgcttaaaggtgacccagtgtaacatcgcacatgccctggaaaagagcaagtacctgtttagcaatctgtattggcaggatctggaagacaagtaccactttagcctgcaatttacagccgatctgattgcaatgaatgcagcgaatttcatcattagcagtacctaccaggagattgttggcactccggattccatcggtcaatacgagagctatcaatccttcaccatgccagacctgtaccatgtggttaatggcattgaactgttcagtccaaagtttaatgttgttccaccgggcgttaatgaacaggtgtattttccgtattatcattataccgaacgcctggaaggtgatcgccaacgcctggaagaactgctttttactctggaagatccgcagcagatttacggctacctggaagcacccgaaaaacgtccgttgttcagtatggctcgtctggatcgcatcaagaacctgaccggtttagccgaagcatttggccgtagcaaggcactgcaagaacgttgcaacctcattctggtagcgggcaaattacgcaccgcagatagcagcgaccgtgaagaaattgcggagatcgaaaaactgtaccagatcatccaccagtataacctgcatggcaagattcgttggcttggtattcgccttccgaaagccgatagcggcgaaatctaccgcattatcgcagatcgccagggcatttttgtgcaaccggcgttgtttgaagcgttcggcctgactattctggaggcgatgattagcggtctgccgacttttggcacccgcttcggtggtccgctggagatcatccaggatggtgtcaacggcttctacattaatccgactcatctggaagaaatggctgagacgattgtgcgcttcctggaagcatgtgaccgcgatccgcaggaatggcagcgcattagcaaggcgggcattgagcgtgtttatagcacctacacgtggaagatccattgcacccgcctgctgagcctggccaaaatctacggcttttggaattttagcagccaagaaaaccgcgaagatatgatgcgttacatggaagcactgttccatctgctgtataaaccgcgtgctcaggcactgctggccgaacatcttcagcgttaa

SEQ ID NO: 72 - protein, 819 aa, Artificial Sequence
  Codon optimized Thermosynechococcus elongatus sucrose synthase
MHHHHHHGGSGMTCVLLKAVVESDERADLRQFSRILQLGEKRYLLRNDILDAFADYCRDQERPVPPPSESRLSKLVFYTQEIIVDNESLCWIVRPRIAQQEVCRLLVEDLTIVPMTIPELLDLRDRLVNHYHPNEGDVFEIDVQPFYDYSPIIRDAKNIGKGVEFLNRYLSSKLFQDPRQWQQNLFNFLRIHRYNGYQLLINERIRSPQHLSEQVKQALVVLSDRPPTEAYSEFRFELQNLGFEPGWGNTVARVRDTLEILDQLLDSPDHQVLEAFVSRIPMLFRIALISPHGWFGQEGVLGRPDTGGQVVYILDQVKSLEKQMREDLELAGLGVLEAQPKIIVLTRLIPNAEGTLCNQRLEKIYGTNDAWILRVPFREFNPKVTQNWISRFEIWPYLETFAIDAERELRAEFGHVPDLIIGNYSDGNLVAFLLARRLKVTQCNIAHALEKSKYLFSNLYWQDLEDKYHFSLQFTADLIAMNAANFIISSTYQEIVGTPDSIGQYESYQSFTMPDLYHVVNGIELFSPKFNVVPPGVNEQVYFPYYHYTERLEGDRQRLEELLFTLEDPQQIYGYLEAPEKRPLFSMARLDRIKNLTGLAEAFGRSKALQERCNLILVAGKLRTADSSDREEIAEIEKLYQIIHQYNLHGKIRWLGIRLPKADSGEIYRIIADRQGIFVQPALFEAFGLTILEAMISGLPTFGTRFGGPLEIIQDGVNGFYINPTHLEEMAETIVRFLEACDRDPQEWQRISKAGIERVYSTYTWKIHCTRLLSLAKIYGFWNFSSQENREDMMRYMEALFHLLYKPRAQALLAEHLQR

SEQ ID NO: 73 - DNA, 2415 bp, Artificial Sequence
  Codon optimized Acidithiobacillus caldus sucrose synthase
atgcaccatcatcatcatcatggcggtagcggcatgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggagtaa

SEQ ID NO: 74 - protein, 804 aa, Artificial Sequence
  Codon optimized Acidithiobacillus caldus sucrose synthase
MHHHHHHGGSGMIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 75 - DNA, 1410 bp, Artificial Sequence
  ADP-Glycosyltransferase Circular Permuted Variant of SEQ ID NO: 32
atgccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgattaa

SEQ ID NO: 76 - protein, 469 aa, Artificial Sequence
  ADP-Glycosyltransferase Circular Permuted Variant of SEQ ID NO: 32
MPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDND

SEQ ID NO: 77 - DNA, 1410 bp, Artificial Sequence
  ADP-Glycosyltransferase Circular Permuted Variant of SEQ ID NO: 32
atgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgtaa

SEQ ID NO: 78 - protein, 469 aa, Artificial Sequence
  ADP-Glycosyltransferase Circular Permuted Variant of SEQ ID NO: 32
MQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDP

SEQ ID NO: 79 - DNA, 1410 bp, Artificial Sequence
  ADP-Glycosyltransferase Circular Permuted Variant of SEQ ID NO: 32
atggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcagtaa

SEQ ID NO: 80 - protein, 469 aa, Artificial Sequence
  ADP-Glycosyltransferase Circular Permuted Variant of SEQ ID NO: 32
MDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQ

SEQ ID NO: 81 - DNA, 1410 bp, Artificial Sequence
  ADP-Glycosyltransferase Circular Permuted Variant of SEQ ID NO: 32
atggagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggactaa

SEQ ID NO: 82 - protein, 469 aa, Artificial Sequence
  ADP-Glycosyltransferase Circular Permuted Variant of SEQ ID NO: 32
MERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQD

SEQ ID NO: 83 - DNA, 1410 bp, Artificial Sequence
  ADP-Glycosyltransferase Circular Permuted Variant of SEQ ID NO: 32
atgcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagtaa

SEQ ID NO: 84 - protein, 469 aa, Artificial Sequence
  ADP-Glycosyltransferase Circular Permuted Variant of SEQ ID NO: 32
MRISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDE

SEQ ID NO: 85 - DNA, 1410 bp, Artificial Sequence
  ADP-Glycosyltransferase Circular Permuted Variant of SEQ ID NO: 32
atgattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgttaa

SEQ ID NO: 86 - protein, 469 aa, Artificial Sequence
  ADP-Glycosyltransferase Circular Permuted Variant of SEQ ID NO: 32
MISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDER

SEQ ID NO: 87 - DNA, 1410 bp, Artificial Sequence
  ADP-Glycosyltransferase Circular Permuted Variant of SEQ ID NO: 32
atggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccgtaa

SEQ ID NO: 88 - protein, 469 aa, Artificial Sequence
  ADP-Glycosyltransferase Circular Permuted Variant of SEQ ID NO: 32
MDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDP

SEQ ID NO: 89 - DNA, 1410 bp, Artificial Sequence
  ADP-Glycosyltransferase Circular Permuted Variant of SEQ ID NO: 32
atggataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggactaa

SEQ ID NO: 90 - protein, 469 aa, Artificial Sequence
  ADP-Glycosyltransferase Circular Permuted Variant of SEQ ID NO: 32
MDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPD

SEQ ID NO: 91 - DNA, 1410 bp, Artificial Sequence
  ADP-Glycosyltransferase Circular Permuted Variant of SEQ ID NO: 32
atgaaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgattaa

SEQ ID NO: 92 - protein, 469 aa, Artificial Sequence
  ADP-Glycosyltransferase Circular Permuted Variant of SEQ ID NO: 32
MKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDD

SEQ ID NO: 93 - DNA, 1410 bp, Artificial Sequence
  ADP-Glycosyltransferase Circular Permuted Variant of SEQ ID NO: 32
atgctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgttaa

SEQ ID NO: 94 - protein, 469 aa, Artificial Sequence
  ADP-Glycosyltransferase Circular Permuted Variant of SEQ ID NO: 32
MLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTR

SEQ ID NO: 95 - DNA, 1410 bp, Artificial Sequence
  ADP-Glycosyltransferase Circular Permuted Variant of SEQ ID NO: 32
atgagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtattaa

SEQ ID NO: 96 - protein, 469 aa, Artificial Sequence
  ADP-Glycosyltransferase Circular Permuted Variant of SEQ ID NO: 32
MSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAY

SEQ ID NO: 97 - DNA, 1410 bp, Artificial Sequence
  ADP-Glycosyltransferase Circular Permuted Variant of SEQ ID NO: 32
atgatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagtaa

SEQ ID NO: 98 - protein, 469 aa, Artificial Sequence
  ADP-Glycosyltransferase Circular Permuted Variant of SEQ ID NO: 32
MILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQ

SEQ ID NO: 99 - DNA, 1410 bp, Artificial Sequence
  ADP-Glycosyltransferase Circular Permuted Variant of SEQ ID NO: 32
atgcacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggactaa

SEQ ID NO: 100 - protein, 469 aa, Artificial Sequence
  ADP-Glycosyltransferase Circular Permuted Variant of SEQ ID NO: 32
MHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLD

SEQ ID NO: 101 - DNA, 1410 bp, Artificial Sequence
  ADP-Glycosyltransferase Circular Permuted Variant of SEQ ID NO: 32
atggatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccactaa

SEQ ID NO: 102 - protein, 469 aa, Artificial Sequence
  ADP-Glycosyltransferase Circular Permuted Variant of SEQ ID NO: 32
MDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDH

SEQ ID NO: 103 - DNA, 1410 bp, Artificial Sequence
  ADP-Glycosyltransferase Circular Permuted Variant of SEQ ID NO: 32
atgccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgtttaa

SEQ ID NO: 104 - protein, 469 aa, Artificial Sequence
  ADP-Glycosyltransferase Circular Permuted Variant of SEQ ID NO: 32
MPMIFSDFGLDQPLNARYMSDVLKVGVYLENGWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGV

SEQ ID NO: 105 - DNA, 1410 bp, Artificial Sequence
  ADP-Glycosyltransferase Circular Permuted Variant of SEQ ID NO: 32
atgtgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctaa

SEQ ID NO: 106 - protein, 469 aa, Artificial Sequence
  ADP-Glycosyltransferase Circular Permuted Variant of SEQ ID NO: 32
MWERGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENG

SEQ ID NO: 107 - DNA, 1410 bp, Artificial Sequence
  ADP-Glycosyltransferase Circular Permuted Variant of SEQ ID NO: 32
atgcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctcgagcatcaccatcaccatcacggtggcagcggtatggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagtaa

SEQ ID NO: 108 - protein, 469 aa, Artificial Sequence
  ADP-Glycosyltransferase Circular Permuted Variant of SEQ ID NO: 32
MRGEIANAIRRVMVDEEGEYIRQNARVLKQKADVSLMKGGSSYESLESLVSYISSLEHHHHHHGGSGMENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWE

SEQ ID NO: 109 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccggcggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 110 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPAAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 111 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcgggaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 112 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIGKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 113 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 114 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 115 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtgcgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 116 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGARIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 117 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatccagaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 118 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIQKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 119 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcgataaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 120 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIDKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 121 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgctgaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 122 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 123 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 124 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 125 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatgctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 126 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQMLKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 127 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatctcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 128 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQISKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 129 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcaggtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 130 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAQVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 131 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagggcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 132 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKRAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 133 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagtctctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 134 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSLKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 135 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcaagaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 136 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 137 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgttggtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 138 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 139 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 140 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 141 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggttgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 142 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 143 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcaggttctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 144 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQVLKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 145 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggcggtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 146 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAAVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 147 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcgctggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 148 - protein, 457 aa, Artificial Sequence
  ADP-Glycosyltransferase variant of SEQ ID NO: 32
MENKTETTVRRRRIILFPVPFAGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 149 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccttggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 150 - protein, 457 aa, Artificial Sequence
  ADP-Glycosyltransferase variant of SEQ ID NO: 32
MENKTETTVRRRRIILFPVPFLGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 151 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 152 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 153 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggtggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 154 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 155 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccatggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 156 - protein, 457 aa, Artificial Sequence
  ADP-Glycosyltransferase variant of SEQ ID NO: 32
MENKTETTVRRRRIILFPVPFHGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 157 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 158 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 159 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtggggtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 160 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRGVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 161 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccgacggataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 162 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPTDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 163 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 164 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 165 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcggtgggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 166 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQAVGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 167 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgatgtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 168 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPMFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 169 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttcggcgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 170 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 171 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgttaggctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 172 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVRLENGWERGEIANAIRRVMVDEEGEYIRQNARVLKQKADVSLMKGGSSYESLESLVSYISSL

SEQ ID NO: 173 - DNA, 1371 bp, Artificial Sequence
  ADP-Glycosyltransferase variant of SEQ ID NO: 32
atggagaacaaaacccctaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggggaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 174 - protein, 457 aa, Artificial Sequence
  ADP-Glycosyltransferase variant of SEQ ID NO: 32
MENKTPTTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 175 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcctcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 176 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLPRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 177 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 178 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEVIRQNARVLKQKADVSLMKGGSSYESLESLVSYISSL

SEQ ID NO: 179 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgattggaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 180 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDWTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 181 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaatctctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 182 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELESLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 183 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctggggctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 184 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLGLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 185 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggctcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 186 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGSDELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 187 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagtggattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 188 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDEWISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 189 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctgtcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 190 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLSSEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 191 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcctaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 192 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 193 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgaggtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 194 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPRFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 195 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcgggtggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 196 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSGWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 197 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 198 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDREGEYIRQNARVLKQKADVSLMKGGSSYESLESLVSYISSL

SEQ ID NO: 199 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaaactctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 200 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELETLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 201 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcggcggttctgaagcaaaaagcggatgttagcctgatgaagggtggcagcagctacgagagcctggaaagcctggttagctatattagcagcctg

SEQ ID NO: 202 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNAAVLKQKADVSLMKGGSSYESLESLVSYISSL

SEQ ID NO: 203 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtccgatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 204 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRPILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 205 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccaggatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 206 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDQDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 207 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcataccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 208 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDHTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 209 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccctgaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 210 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDPEGEYIRQNARVLKQKADVSLMKGGSSYESLESLVSYISSL

SEQ ID NO: 211 - DNA, 1371 bp, Artificial Sequence
  ADP-Glycosyltransferase variant of SEQ ID NO: 32
atggagaacccgaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 212 - protein, 457 aa, Artificial Sequence
  ADP-Glycosyltransferase variant of SEQ ID NO: 32
MENPTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 213 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatcagagcctgatgaagggtggcagcagctacgagagcctggaaagcctggttagctatattagcagcctg

SEQ ID NO: 214 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADQSLMKGGSSYESLESLVSYISSL

SEQ ID NO: 215 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaaggtctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 216 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELEGLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 217 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaagatctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 218 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELEDLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 219 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatgcgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 220 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDATVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 221 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgcggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 222 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDAEGEYIRQNARVLKQKADVSLMKGGSSYESLESLVSYISSL

SEQ ID NO: 223 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 224 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASPEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 225 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatcggagcctgatgaagggtggcagcagctacgagagcctggaaagcctggttagctatattagcagcctg

SEQ ID NO: 226 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADRSLMKGGSSYESLESLVSYISSL

SEQ ID NO: 227 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgctgaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 228 - protein, 457 aa, Artificial Sequence
  ADP-Glycosyltransferase variant of SEQ ID NO: 32
MENKTETTVRRRRIILFPVPFQGHINPILQLANVLYSKGFSITIFHTNFNKPKTSNYPHFTFRFILDNDPQDERISNLPTHGPLAGMRIPIINEHGADELRRELELLMLASAEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 229 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 230 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 231 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 232 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 233 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 234 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSSKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 235 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccggtcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 236 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPVAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQSSKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 237 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 238 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQSAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 239 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 240 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 241 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 242 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQISKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 243 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 244 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSSKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 245 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 246 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 247 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 248 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 249 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 250 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 251 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcaaaaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 252 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQIKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 253 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 254 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQISKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 255 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 256 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 257 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 258 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQSSKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 259 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 260 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 261 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 262 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 263 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 264 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSAKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 265 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 266 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 267 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 268 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 269 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 270 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQIKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 271 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccaggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 272 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQSSKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 273 - DNA, 1371 bp, Artificial Sequence
  ADP-Glycosyltransferase variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 274 - protein, 457 aa, Artificial Sequence
  ADP-Glycosyltransferase variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 275 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 276 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 277 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcagcaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 278 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQISKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 279 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 280 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 281 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 282 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQSSKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 283 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 284 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 285 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 286 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQIAKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 287 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 288 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQISKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 289 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 290 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSAKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 291 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgaacgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 292 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 293 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 294 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 295 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 296 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 297 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 298 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQIKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 299 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcaaaaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 300 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQIKKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 301 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 302 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 303 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagatcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 304 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQISKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 305 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 306 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 307 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 308 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 309 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagtcgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 310 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVESLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 311 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 312 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 313 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcaaaaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 314 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQIKKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 315 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 316 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSSKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 317 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 318 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 319 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 320 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSSKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 321 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 322 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSSKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 323 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 324 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 325 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 326 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 327 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 328 - protein, 457 aa, Artificial Sequence
  ADP-Glycosyltransferase Variant of SEQ ID NO: 32
MENKTETTVRRRRIILFPVPFQGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 329 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcagcaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 330 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQISKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 331 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 332 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGHRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 333 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgtgcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 334 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSKKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLCERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 335 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 336 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 337 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 338 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 339 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtcatcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagagcgcgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttgtgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 340 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGHRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQSAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFVWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 341 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgcttaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 342 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMLKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 343 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 344 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 345 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcggtggtgagcctgccgcagtttgacgagcttggctacctggatccggacgataaaacccgtctggaggaacaagcgagcggtttcccgatgctgaaggttaaagatatcaagagcgcgtatagcaactggcagagcaaaaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacagcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 346 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHAVVSLPQFDELGYLDPDDKTRLEEQASGFPMLKVKDIKSAYSNWQSKKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHSGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 347 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 348 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADVSLMKGGSSYESLESLVSYISSL

SEQ ID NO: 349 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaaaccctgatgcgggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgaggtgatccgtcagaacgcggctgttctgaagcaaaaagcggatgttagcctgatgaagggtggcagcagctacgagagcctggaaagcctggttagctatattagcagcctg

SEQ ID NO: 350 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMRASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDAEGEVIRQNAAVLKQKADVSLMKGGSSYESLESLVSYISSL

SEQ ID NO: 351 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgaggtgatccgtcagaacgcgcttgttctgaagcaaaaagcggatgttagcctgatgaagggtggcagcagctacgagagcctggaaagcctggttagctatattagcagcctg

SEQ ID NO: 352 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPQFDELGYLDPDDKTRLEEQAVGFPMLKVKDIKSAYSNWQIAKEILDKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNALVLKQKADVSLMKGGSSYESLESLVSYISSL

SEQ ID NO: 353 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 354 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMRASPEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEYIRQNARVLKQKADVSLMKGGSSYESLESLVSYISSL

SEQ ID NO: 355 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagccctgaagacgaggaagttagctgcctgattaccgatgcgctgtggtacttcgcgcaaccggtggcggacagcctgaacctgcgtcgtctggttctgatgaccagcagcctgtttaacttccacgcgctggtgagcctgccgcggtttgacgagcttggctacctggatccggacgataaaacccgtctggaggaacaagcgagcggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgcagaaggtgaggtgatccgtcagaacgcgcttgttctgaagcaaaaagcggatgttagcctgatgaagggtggcagcagctacgagagcctggaaagcctggttagctatattagcagcctg

SEQ ID NO: 356 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLRRLVLMTSSLFNFHALVSLPRFDELGYLDPDDKTRLEEQASGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDAEGEVIRQNALVLKQKADVSLMKGGSSYESLESLVSYISSL

SEQ ID NO: 357 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgagtatatccgtcagaacgcggctgttctgaagcaaaaagcggatgttagcctgatgaagggtggcagcagctacgagagcctggaaagcctggttagctatattagcagcctg

SEQ ID NO: 358 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNAAVLKQKADVSLMKGGSSYESLESLVSYISSL

SEQ ID NO: 359 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgttaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgcagaaggtgagtatatccgtcagaacgcggctgttctgaaggacaaagcggatgttagcctgatgaagggtggcagcagctacgagagcctggaaagcctggttagctatattagcagcctg

SEQ ID NO: 360 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELESLMLASEEDEEVSCLITDALWYFAQSVADSLNLPRLVLMTSSLFNFHALVSLPQFDELGYLDPDDKTRLEEQALGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEYIRQNAAVLKDKADVSLMKGGSSYESLESLVSYISSL

SEQ ID NO: 361 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgttaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcttgttctgaaggacaaagcggatgttagcctgatgaagggtggcagcagctacgagagcctggaaagcctggttagctatattagcagcctg

SEQ ID NO: 362 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELESLMRASEEDEEVSCLITDALWYFAQSVADSLNLPRLVLMTSSLFNFHALVSLPQFDELGYLDPDDKTRLEEQALGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNALVLKDKADVSLMKGGSSYESLESLVSYISSL

SEQ ID NO: 363 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagccctgaagacgaggaagttagctgcctgattaccgatgcgctgtggtacttcgcgcaaccggtggcggacagcctgaacctgcgtcgtctggttctgatgaccagcagcctgtttaacttccacgcgctggtgagcctgccgcggtttgacgagcttggctacctggatccggacgataaaacccgtctggaggaacaagcgttaggtttcccgatgctgaaggttaaagatatcaagagcgcgtatagcaactggcagatcgcgaaagaaattctgggtaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 364 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLRRLVLMTSSLFNFHALVSLPRFDELGYLDPDDKTRLEEQALGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNARVLKQKADVSLMKGGSSYESLESLVSYISSL

SEQ ID NO: 365 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 366 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMRASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 367 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagccctgaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcggtttgacgagcttggctacctggatccggacgataaaacccgtctggaggaacaagcgtccggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcggctgttctgaaggacaaagcggatgttagcctgatgaagggtggcagcagctacgagagcctggaaagcctggttagctatattagcagcctg

SEQ ID NO: 368 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMLASPEDEEVSCLITDALWYFAQSVADSLNLRRLVLMTSSLFNFHALVSLPRFDELGYLDPDDKTRLEEQASGFPMLKVKDIKSAYSNWQIAKEILDKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 369 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcgcgtgttctgaaggacaaagcggatgttagcctgatgaagggtggcagcagctacgagagcctggaaagcctggttagctatattagcagcctg

SEQ ID NO: 370 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNARVLKDKADVSLMKGGSSYESLESLVSYISSL

SEQ ID NO: 371 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 372 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEYIRQNARVLKQKADVSLMKGGSSYESLESLVSYISSL

SEQ ID NO: 373 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcggtttgacgagcttggctacctggatccggacgataaaacccgtctggaggaacaagcggtaggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 374 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPRFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 375 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaaccctgatgctggcgagcgaggaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctgggtaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcggctgttctgaaggacaaagcggatgttagcctgatgaagggtggcagcagctacgagagcctggaaagcctggttagctatattagcagcctg

SEQ ID NO: 376 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEYIRQNAAVLKDKADVSLMKGGSSYESLESLVSYISSL

SEQ ID NO: 377 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcggtttgacgagcttggctacctggatccggacgataaaacccgtctggaggaacaagcgttaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggcgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgagtatatccgtcagaatgcacgtgttctgaaggacaaagcggatgttagcctgatgaagggtggcagcagctacgagagcctggaaagcctggttagctatattagcagcctg

SEQ ID NO: 378 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMRASPEDEEVSCLITDALWYFAQSVADSLNLPRLVLMTSSLFNFHALVSLPRFDELGYLDPDDKTRLEEQALGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNARVLKDKADVSLMKGGSSYESLESLVSYISSL

SEQ ID NO: 379 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagccctgaagacgaggaagttagctgcctgattaccgatgcgctgtggtacttcgcgcaaccggtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgttaggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 380 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASPEDEEVSCLITDALWYFAQPVADSLNLRRLVLMTSSLFNFHALVSLPQFDELGYLDPDDKTRLEEQALGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 381 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaaccctgatgctggcgagccctgaagacgaggaagttagctgcctgattaccgatgcgctgtggtacttcgcgcaatcggtggcggacagcctgaacctgcggcgtctggttctgatgaccagcagcctgtttaacttccacgcgctggtgagcctgccgcggtttgacgagcttggctacctggatccggacgataaaacccgtctggaggaacaagcgttaggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 382 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELETLMLASPEDEEVSCLITDALWYFAQSVADSLNLRRLVLMTSSLFNFHALVSLPRFDELGYLDPDDKTRLEEQALGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 383 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgaggtgatccgtcagaacgcggctgttctgaaggacaaagcggatgttagcctgatgaagggtggcagcagctacgagagcctggaaagcctggttagctatattagcagcctg

SEQ ID NO: 384 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELESLMRASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNAAVLKDKADVSLMKGGSSYESLESLVSYISSL

SEQ ID NO: 385 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagccctgaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaggaaggtgagtacatccgtcagaacgcggctgttctgaagcaaaaagcggatgttagcctgatgaagggtggcagcagctacgagagcctggaaagcctggttagctatattagcagcctg

SEQ ID NO: 386 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDEEGEYIRQNAAVLKQKADVSLMKGGSSYESLESLVSYISSL

SEQ ID NO: 387 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaattactgatgctggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggtaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcacttgttctgaaggacaaagcggatgttagcctgatgaagggtggcagcagctacgagagcctggaaagcctggttagctatattagcagcctg

SEQ ID NO: 388 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMLASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNALVLKDKADVSLMKGGSSYESLESLVSYISSL

SEQ ID NO: 389 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcggtttgacgagcttggctacctggatccggacgataaaacccgtctggaggaacaagcggtaggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 390 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMRASEEDEEVSCLITDALWYFAQSVADSLNLRRLVLMTSSLFNFHALVSLPRFDELGYLDPDDKTRLEEQAVGFPMLKVKDIKSAYSNWQIAKEILDKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 391 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaaccctgatgctggcgagcgaggaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgcagaaggtgaggtgatccgtcagaacgcggctgttctgaagcaaaaagcggatgttagcctgatgaagggtggcagcagctacgagagcctggaaagcctggttagctatattagcagcctg

SEQ ID NO: 392 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELETLMLASEEDEEVSCLITDALWYFAQSVADSLNLRRLVLMTSSLFNFHALVSLPQFDELGYLDPDDKTRLEEQASGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNAAVLKQKADVSLMKGGSSYESLESLVSYISSL

SEQ ID NO: 393 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 394 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 395 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 396 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELESLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 397 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagccctgaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcggtttgacgagcttggctacctggatccggacgataaaacccgtctggaggaacaagcgagcggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 398 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASPEDEEVSCLITDALWYFAQSVADSLNLRRLVLMTSSLFNFHALVSLPRFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 399 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgcagaaggtgagtatatccgtcagaacgcggctgttctgaaggacaaagcggatgttagcctgatgaagggtggcagcagctacgagagcctggaaagcctggttagctatattagcagcctg

SEQ ID NO: 400 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEYIRQNAAVLKDKADVSLMKGGSSYESLESLVSYISSL

SEQ ID NO: 401 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 402 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMLASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNARVLKQKADVSLMKGGSSYESLESLVSYISSL

SEQ ID NO: 403 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgagtatatccgtcagaacgcgcgtgttctgaaggacaaagcggatgttagcctgatgaagggtggcagcagctacgagagcctggaaagcctggttagctatattagcagcctg

SEQ ID NO: 404 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEYIRQNARVLKDKADVSLMKGGSSYESLESLVSYISSL

SEQ ID NO: 405 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaccggtggcggacagcctgaacctgcgtcgtctggttctgatgaccagcagcctgtttaacttccacgcgctggtgagcctgccgcggtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 406 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQPVADSLNLRRLVLMTSSLFNFHALVSLPRFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 407 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaactgctgatgcgggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgttaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggcgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcggctgttctgaagcaaaaagcggatgttagcctgatgaagggtggcagcagctacgagagcctggaaagcctggttagctatattagcagcctg

SEQ ID NO: 408 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQSVADSLNLPRLVLMTSSLFNFHALVSLPQFDELGYLDPDDKTRLEEQALGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNAAVLKQKADVSLMKGGSSYESLESLVSYISSL

SEQ ID NO: 409 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaaccctgatgctggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 410 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMLASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEVIRQNARVLKQKADVSLMKGGSSYESLESLVSYISSL

SEQ ID NO: 411 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgaggtgatccgtcagaacgcgcttgttctgaagcaaaaagcggatgttagcctgatgaagggtggcagcagctacgagagcctggaaagcctggttagctatattagcagcctg

SEQ ID NO: 412 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNALVLKQKADVSLMKGGSSYESLESLVSYISSL

SEQ ID NO: 413 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgctggcgagccctgaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 414 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 415 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcgcttgttctgaaggacaaagcggatgttagcctgatgcctggtggcagcagctacgagagcctggaaagcctggttagctatattagcagcctg

SEQ ID NO: 416 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMLASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNALVLKDKADVSLMPGGSSYESLESLVSYISSL

SEQ ID NO: 417 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaaccctgatgctggcgagccctgaagacgaggaagttagctgcctgattaccgatgcgctgtggtacttcgcgcaatcggtggcggacagcctgaacctgcggcgtctggttctgatgaccagcagcctgtttaacttccacgcgctggtgagcctgccgcggtttgacgagcttggctacctggatccggacgataaaacccgtctggaggaacaagcgttaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 418 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMLASPEDEEVSCLITDALWYFAQSVADSLNLRRLVLMTSSLFNFHALVSLPRFDELGYLDPDDKTRLEEQALGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNARVLKQKADVSLMKGGSSYESLESLVSYISSL

SEQ ID NO: 419 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcttgttctgaaggacaaagcggatgttagcctgatgaagggtggcagcagctacgagagcctggaaagcctggttagctatattagcagcctg

SEQ ID NO: 420 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNALVLKDKADVSLMKGGSSYESLESLVSYISSL

SEQ ID NO: 421 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaagaaggtgaggtgatccgtcagaacgcggctgttctgaagcaaaaagcggatgttagcctgatgaagggtggcagcagctacgagagcctggaaagcctggttagctatattagcagcctg

SEQ ID NO: 422 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEVIRQNAAVLKQKADVSLMKGGSSYESLESLVSYISSL

SEQ ID NO: 423 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 424 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQSVADSLNLRRLVLMTSSLFNFHALVSLPQFDELGYLDPDDKTRLEEQAVGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEVIRQNARVLKQKADVSLMKGGSSYESLESLVSYISSL

SEQ ID NO: 425 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaaccctgatgctggcgagccctgaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcggtttgacgagcttggctacctggatccggacgataaaacccgtctggaggaacaagcggtaggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgcagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 426 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELETLMLASPEDEEVSCLITDALWYFAQSVADSLNLPRLVLMTSSLFNFHALVSLPRFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDAEGEYIRQNARVLKQKADVSLMKGGSSYESLESLVSYISSL

SEQ ID NO: 427 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgagtatatccgtcagaacgcgcgtgttctgaaggacaaagcggatgttagcctgatgaagggtggcagcagctacgagagcctggaaagcctggttagctatattagcagcctg

SEQ ID NO: 428 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQSVADSLNLRRLVLMTSSLFNFHALVSLPQFDELGYLDPDDKTRLEEQASGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNARVLKDKADVSLMKGGSSYESLESLVSYISSL

SEQ ID NO: 429 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaattggcagatcgcgaaagaaattctgggtaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcacgtgttctgaagcaaaaagcggatgttagcctgatgaagggtggcagcagctacgagagcctggaaagcctggttagctatattagcagcctg

SEQ ID NO: 430 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 431 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcggaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 432 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEYIRQNARVLKQKADVSLMKGGSSYESLESLVSYISSL

SEQ ID NO: 433 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaggaaggtgagtacatccgtcagaacgcggctgttctgaaggacaaagcggatgttagcctgatgaagggtggcagcagctacgagagcctggaaagcctggttagctatattagcagcctg

SEQ ID NO: 434 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELESLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDEEGEYIRQNAAVLKDKADVSLMKGGSSYESLESLVSYISSL

SEQ ID NO: 435 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaggaaggtgagtacatccgtcagaacgcggctgttctgaaggacaaagcggatgttagcctgatgaagggtggcagcagctacgagagcctggaaagcctggttagctatattagcagcctg

SEQ ID NO: 436 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNAAVLKDKADVSLMKGGSSYESLESLVSYISSL

SEQ ID NO: 437 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcggtttgacgagcttggctacctggatccggacgataaaacccgtctggaggaacaagcgtccggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcggctgttctgaaggacaaagcggatgttagcctgatgaagggtggcagcagctacgagagcctggaaagcctggttagctatattagcagcctg

SEQ ID NO: 438 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMLASEEDEEVSCLITDALWYFAQSVADSLNLPRLVLMTSSLFNFHALVSLPRFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 439 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagccctgaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 440 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMLASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDREGEVIRQNARVLKQKADVSLMKGGSSYESLESLVSYISSL

SEQ ID NO: 441 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaagaaggtgaggtgatccgtcagaacgcgcgtgttctgaagcaaaaagcggatgttagcctgatgcctggtggcagcagctacgagagcctggaaagcctggttagctatattagcagcctg

SEQ ID NO: 442 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQSVADSLNLRRLVLMTSSLFNFHALVSLPQFDELGYLDPDDKTRLEEQASGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDEEGEVIRQNARVLKQKADVSLMPGGSSYESLESLVSYISSL

SEQ ID NO: 443 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 444 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEYIRQNARVLKQKADVSLMKGGSSYESLESLVSYISSL

SEQ ID NO: 445 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaactgctgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 446 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 447 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcggaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcggctgttctgaaggacaaagcggatgttagcctgatgaagggtggcagcagctacgagagcctggaaagcctggttagctatattagcagcctg

SEQ ID NO: 448 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNAAVLKDKADVSLMKGGSSYESLESLVSYISSL

SEQ ID NO: 449 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgcgggcgagcgaggaagacgaggaagttagctgcctgattaccgatgcgctgtggtacttcgcgcaaccggtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 450 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLNLRRLVLMTSSLFNFHALVSLPQFDELGYLDPDDKTRLEEQASGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 451 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcggaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 452 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEYIRQNARVLKQKADVSLMKGGSSYESLESLVSYISSL

SEQ ID NO: 453 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaaccctgatgcgggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 454 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMRASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNARVLKQKADVSLMKGGSSYESLESLVSYISSL

SEQ ID NO: 455 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaaaccctgatgcgggcgagcgaggaagacgaggaagttagctgcctgattaccgatgcgctgtggtacttcgcgcaatcggtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcggctgttctgaaggacaaagcggatgttagcctgatgaagggtggcagcagctacgagagcctggaaagcctggttagctatattagcagcctg

SEQ ID NO: 456 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNAAVLKDKADVSLMKGGSSYESLESLVSYISSL

SEQ ID NO: 457 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcgaggaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcgcttgttctgaagcaaaaagcggatgttagcctgatgaagggtggcagcagctacgagagcctggaaagcctggttagctatattagcagcctg

SEQ ID NO: 458 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNALVLKQKADVSLMKGGSSYESLESLVSYISSL

SEQ ID NO: 459 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 460 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPQFDELGYLDPDDKTRLEEQASGFPMLKVKDIKSAYSNWQIAKEILDKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNARVLKQKADVSLMKGGSSYESLESLVSYISSL

SEQ ID NO: 461 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcggtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgaggtgatccgtcagaacgcgcgtgttctgaaggacaaagcggatgttagcctgatgaagggtggcagcagctacgagagcctggaaagcctggttagctatattagcagcctg

SEQ ID NO: 462 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQSVADSLNLRRLVLMTSSLFNFHALVSLPRFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDAEGEVIRQNARVLKDKADVSLMKGGSSYESLESLVSYISSL

SEQ ID NO: 463 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaaccctgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtatatccgtcagaacgcgcgtgttctgaagcaaaaagcggatgttagcctgatgaagggtggcagcagctacgagagcctggaaagcctggttagctatattagcagcctg

SEQ ID NO: 464 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 465 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaccggtggcggacagcctgaacctgcgtcgtctggttctgatgaccagcagcctgtttaacttccacgcgctggtgagcctgccgcggtttgacgagcttggctacctggatccggacgataaaacccgtctggaggaacaagcggtaggtttcccgatgctgaaggttaaagatatcaagagcgcgtatagcaattggcagatcgcgaaagaaattctgggtaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgcctggtggcagcagctacgagagcctggaaagcctggttagctatattagcagcctg

SEQ ID NO: 466 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQPVADSLNLRRLVLMTSSLFNFHALVSLPRFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMPGGSSYESLESLVSYISSL

SEQ ID NO: 467 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcggaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgcagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 468 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELESLMLASPEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDAEGEVIRQNARVLKQKADVSLMKGGSSYESLESLVSYISSL

SEQ ID NO: 469 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcggtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgagtatatccgtcagaacgcgcttgttctgaagcaaaaagcggatgttagcctgatgaagggtggcagcagctacgagagcctggaaagcctggttagctatattagcagcctg

SEQ ID NO: 470 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPRFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNALVLKQKADVSLMKGGSSYESLESLVSYISSL

SEQ ID NO: 471 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagccctgaagacgaggaagttagctgcctgattaccgatgcgctgtggtacttcgcgcaaagcgtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaggaaggtgagtacatccgtcagaacgcggctgttctgaagcaaaaagcggatgttagcctgatgaagggtggcagcagctacgagagcctggaaagcctggttagctatattagcagcctg

SEQ ID NO: 472 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQSVADSLNLRRLVLMTSSLFNFHALVSLPQFDELGYLDPDDKTRLEEQASGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNAAVLKQKADVSLMKGGSSYESLESLVSYISSL

SEQ ID NO: 473 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaaccctgatgcgggcgagccctgaagacgaggaagttagctgcctgattaccgatgcgctgtggtacttcgcgcaaccggtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgttaggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgagtatatccgtcagaacgcggctgttctgaaggacaaagcggatgttagcctgatgaagggtggcagcagctacgagagcctggaaagcctggttagctatattagcagcctg

SEQ ID NO: 474 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELETLMRASPEDEEVSCLITDALWYFAQPVADSLNLRRLVLMTSSLFNFHALVSLPQFDELGYLDPDDKTRLEEQALGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNAAVLKDKADVSLMKGGSSYESLESLVSYISSL

SEQ ID NO: 475 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaagcctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaattggcagatcgcgaaagaaattctgggtaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaaggacaaagcggatgttagcctgatgaagggtggcagcagctacgagagcctggaaagcctggttagctatattagcagcctg

SEQ ID NO: 476 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELESLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKDKADVSLMKGGSSYESLESLVSYISSL

SEQ ID NO: 477 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaattactgatgctggcgagcgaggaagacgaggaagttagctgcctgattaccgatgcgctgtggtacttcgcgcaatcggtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcgtgttctgaaggacaaagcggatgttagcctgatgaagggtggcagcagctacgagagcctggaaagcctggttagctatattagcagcctg

SEQ ID NO: 478 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKDKADVSLMKGGSSYESLESLVSYISSL

SEQ ID NO: 479 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaaccctgatgcgggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcggaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 480 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMRASEEDEEVSCLITDALWYFAQSVADSLNLPRLVLMTSSLFNFHALVSLPQFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 481 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaattactgatgctggcgagccctgaagacgaggaagttagctgcctgattaccgatgcgctgtggtacttcgcgcaaccggtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcggaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgaggtgatccgtcagaacgcgcttgttctgaagcaaaaagcggatgttagcctgatgaagggtggcagcagctacgagagcctggaaagcctggttagctatattagcagcctg

SEQ ID NO: 482 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASPEDEEVSCLITDALWYFAQPVADSLNLRRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEVIRQNALVLKQKADVSLMKGGSSYESLESLVSYISSL

SEQ ID NO: 483 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaaaccctgatgctggcgagccctgaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcggtttgacgagcttggctacctggatccggacgataaaacccgtctggaggaacaagcggtaggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgcagaaggtgaggtgatccgtcagaacgcgcttgttctgaagcaaaaagcggatgttagcctgatgcctggtggcagcagctacgagagcctggaaagcctggttagctatattagcagcctg

SEQ ID NO: 484 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMLASPEDEEVSCLITDALWYFAQSVADSLNLRRLVLMTSSLFNFHALVSLPRFDELGYLDPDDKTRLEEQAVGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNALVLKQKADVSLMPGGSSYESLESLVSYISSL

SEQ ID NO: 485 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagccctgaagacgaggaagttagctgcctgattaccgatgcgctgtggtacttcgcgcaaccggtggcggacagcctgaacctgcggcgtctggttctgatgaccagcagcctgtttaacttccacgcgctggtgagcctgccgcggtttgacgagcttggctacctggatccggacgataaaacccgtctggaggaacaagcgtccggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctagaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaagaaggtgaggtgatccgtcagaacgcgcttgttctgaaggacaaagcggatgttagcctgatgaagggtggcagcagctacgagagcctggaaagcctggttagctatattagcagcctg

SEQ ID NO: 486 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELESLMRASPEDEEVSCLITDALWYFAQPVADSLNLRRLVLMTSSLFNFHALVSLPRFDELGYLDPDDKTRLEEQASGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEVIRQNALVLKDKADVSLMKGGSSYESLESLVSYISSL

SEQ ID NO: 487 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgctggcgagcgaggaagacgaggaagttagctgcctgattaccgatgcgctgtggtacttcgcgcaaccggtggcggacagcctgaacctgcggcgtctggttctgatgaccagcagcctgtttaacttccacgcgctggtgagcctgccgcagtttgacgagcttggctacctggatccggacgataaaacccgtctggaggaacaagcgttaggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacagagaaggtgagtatatccgtcagaacgcggctgttctgaagcaaaaagcggatgttagcctgatgaagggtggcagcagctacgagagcctggaaagcctggttagctatattagcagcctg

SEQ ID NO: 488 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASEEDEEVSCLITDALWYFAQPVADSLNLRRLVLMTSSLFNFHALVSLPQFDELGYLDPDDKTRLEEQALGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNAAVLKQKADVSLMKGGSSYESLESLVSYISSL

SEQ ID NO: 489 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgcagaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 490 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELELLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNARVLKQKADVSLMKGGSSYESLESLVSYISSL

SEQ ID NO: 491 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcgttaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacagagaaggtgagtatatccgtcagaacgcgcttgttctgaagcaaaaagcggatgttagcctgatgaagggtggcagcagctacgagagcctggaaagcctggttagctatattagcagcctg

SEQ ID NO: 492 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQSVADSLNLPRLVLMTSSLFNFHALVSLPQFDELGYLDPDDKTRLEEQALGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDREGEYIRQNALVLKQKADVSLMKGGSSYESLESLVSYISSL

SEQ ID NO: 493 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtcctatcttggacaacgatccgcaggacgagcgtattagcaacctgccgacccatggtccgggcgcgggtatgcgtatcccgatcattaacgagcacggcgcggatgaactgcgtcgtgagctggaaaccctgatgcgggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgagcggtttcccgatgctgaaggttaaagatatcaagagcgcgtatagcaactggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggtgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgcagaaggtgaggtgatccgtcagaacgcgcttgttctgaaggacaaagcggatgttagcctgatgcctggtggcagcagctacgagagcctggaaagcctggttagctatattagcagcctg

SEQ ID NO: 494 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRPILDNDPQDERISNLPTHGPGAGMRIPIINEHGADELRRELETLMRASEEDEEVSCLITDALWYFAQSVADSLNLRRLVLMTSSLFNFHALVSLPQFDELGYLDPDDKTRLEEQASGFPMLKVKDIKSAYSNWQIAKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDAEGEVIRQNALVLKDKADVSLMPGGSSYESLESLVSYISSL

SEQ ID NO: 495 - DNA, 1371 bp, Artificial Sequence
  ADP-Glycosyltransferase Variant of SEQ ID NO: 232
atggagaacaaaaccgaaactaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaactgctgatgctggcgagccctgaagacgaggaagttagctgcctgattaccgatgcgctgtggtacttcgcgcaaagcgtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaactggcagatcgcgaaagaaattctggataagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaggaaggtgagtacatccgtcagaacgcgcttgttctgaagcaaaaagcggatgttagcctgatgaagggtggcagcagctacgagagcctggaaagcctggttagctatattagcagcctg

SEQ ID NO: 496 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMLASPEDEEVSCLITDALWYFAQSVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDEEGEYIRQNALVLKQKADVSLMKGGSSYESLESLVSYISSL

SEQ ID NO: 497 - DNA, 1371 bp, Artificial Sequence
  ADP-Glycosyltransferase Variant of SEQ ID NO: 232
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaaccctgatgctggcgagcgaggaagacgaggaagttagctgcctgattaccgatgcgctgtggtacttcgcgcaaccggtggcggacagcctgaacctgcgtcgtctggttctgatgaccagcagcctgtttaacttccacgcgctggtgagcctgccgcagtttgacgagcttggctacctggatccggacgataaaacccgtctggaggaacaagcgttaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttagacgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttacctggagaacggctgggagcgtggtgaaatcgcgaacgcgattcgtcgtgtgatggttgacgaagaaggtgaggtgatccgtcagaacgcgcttgttctgaaggacaaagcggatgttagcctgatgaagggtggcagcagctacgagagcctggaaagcctggttagctatattagcagcctg

SEQ ID NO: 498 - protein, 457 aa, Artificial Sequence
  ADP-Glycosyltransferase Variant of SEQ ID NO: 232
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELETLMLASEEDEEVSCLITDALWYFAQPVADSLNLRRLVLMTSSLFNFHALVSLPQFDELGYLDPDDKTRLEEQALGFPMLKVKDIKSAYSNWQIAKEILGKMIKQTRASSGVIWNSFKELEESELETVRREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEVIRQNALVLKDKADVSLMKGGSSYESLESLVSYISSL

SEQ ID NO: 499 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 500 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 501 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcgcgtgttctgaaggataaagcggatgttagcctgatgaagggtggcagcagctacgagagcctggaaagcctggttagctatattagcagcctg

SEQ ID NO: 502 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNARVLKDKADVSLMKGGSSYESLESLVSYISSL

SEQ ID NO: 503 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaagcaaaaagcggatgttagcctgatgaagggtggcagcagctacgagagcctggaaagcctggttagctatattagcagcctg

SEQ ID NO: 504 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKQKADVSLMKGGSSYESLESLVSYISSL

SEQ ID NO: 505 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 506 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 507 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 508 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNARVLKQKADVSLMKGGSSYESLESLVSYISSL

SEQ ID NO: 509 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaagcaaaaagcggatgttagcctgatgaagggtggcagcagctacgagagcctggaaagcctggttagctatattagcagcctg

SEQ ID NO: 510 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKQKADVSLMKGGSSYESLESLVSYISSL

SEQ ID NO: 511 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcggattagcaacctgccgacccatggtccgggcgcgggtatgcgtatcccgatcattaacgagcacggcgcggatgaactgcgtagagagctggaattactgatgcgggcgagcgaggaagacgaggaagttagctgcctgattaccgatgcgctgtggtacttcgcgcaaccggtggcggacagcctggggctgccgcgtctggttctgatgaccagcagcctgtttaacttccacgcgctggtgagcctgccgcagtttttagagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcagaacgcgcgtgttctgaagcaaaaagcggatcgtagcctgatgaagggtggcagcagctacgagagcctggaaagcctggttagctatattagcagcctg

SEQ ID NO: 512 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLGLPRLVLMTSSLFNFHALVSLPQFLELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADRSLMKGGSSYESLESLVSYISSL

SEQ ID NO: 513 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcagaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagtggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggcttggagcgtggtgaaatcgcgaacgcgattcgtcgtgtgatggttgacgaggaaggtgaggtgattcgtcagaacgcgcgtgttctgaagcaaaaagcggatgttagcctgatgaagggtggcagcagctacgagagcctggaaagcctggttagctatattagcagcctg

SEQ ID NO: 514 - protein, 457 aa, Artificial Sequence
  ADP-Glycosyltransferase Variant of SEQ ID NO: 348
MENKTETTVRRRRIILFPVPFPGHINPILQLANVLYSRGFSITIFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQVVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGLERGEIANAIRRVMVDEEGEVIRQNARVLKQKADVSLMKGGSSYESLESLVSYISSL

SEQ ID NO: 515 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtaaagagctggaattactgatgcgggcgagcgaggaagacgaggaagttagctgcctgattaccgatgcgctgtggtacttcgcgcaaccggtggcggacagcctggggctgcctcgtctggttctgatgaccagcagcctgtttaacttccacgcgctggtgagcctgccgcagtttttagagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggacagtgatccgaccgtgttccagtggctggaccagcaaccgccgagcagcgtgctgtacgttagctttggcagccagagcgaggtggacgaatctgatttcctggagattgcgcgtggtctggttgacagcaaacaaagctttctgtggcgcgttcgtccgggcttcgtgaagggtagcgaatgggttgagccgctgccggatggttttctgggcgaacgtggtagaatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 516 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDEWISNLPTHGPGAGMRIPIINEHGADELRKELELLMRASEEDEEVSCLITDALWYFAQPVADSLGLPRLVLMTSSLFNFHALVSLPQFLELGYLDPDDKTRLEEQAVGFPMLKVKDIKSAYSNWQIAKEILGKMIKQTRASSGVIWNSFKELEESELETVIREIPAPSFLIPLPKHLTASSSSLLDSDPTVFQWLDQQPPSSVLYVSFGSQSEVDESDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADVSLMKGGSSYESLESLVSYISSL

SEQ ID NO: 517 - DNA, 1371 bp, Artificial Sequence
  ADP-Glycosyltransferase Variant of SEQ ID NO: 348
atggagaacaaaaccgaaaccaccgtgcgtcgtcgtcgtgttattctgtttccggttccgttcccgggccacatcaacccgattctgcaactggcgaacgtgctgtatagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaatttcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcttgtttaacttccacgcgctggtgagcctgccgcagtttgacgagctaggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggtggacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 518 - protein, 457 aa, Artificial Sequence
  ADP-Glycosyltransferase Variant of SEQ ID NO: 348
MENKTETTVRRRRVILFPVPFPGHINPILQLANVLYSKGFSITIFHTNFNKPKTSNYPHFTFRFILDNDPQDERISNLPTHGPGAGMRIPIINEHGADEFRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADVSLMKGGSSYESLESLVSYISSL

SEQ ID NO: 519 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggtgccgttcccgggccacatcaacccgattctgcaactggcgaacgtgctgtacagcaaaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagtttcgtgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtggcttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggcttggagcgtggtgaaatcgcgaacgcgattcgtcgtgtgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 520 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHGAIGGFWTHGGWNGTLESVCEGVPMIFSDFGLDQPLNARYMSDVLKVGVRLENGLERGEIANAIRRVMVDEEGEVIRQNARVLKQKADVSLMKGGSSYESLESLVSYISSL

SEQ ID NO: 521 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcggggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcatttgcgaaggcgttccgatgatctttagcgacttcggtctggatcagccgctgaacgcgcgttacatgagcgatgttctgaaagtgggcgttcgactggagaacggctgggagcgtggtgaaatcgaaaacgcgattcgtcgtgtgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 522 - protein, 457 aa, Artificial Sequence
  ADP-Glycosyltransferase Variant of SEQ ID NO: 348
MENKTETTVRRRRIILFPVPFPGHINPMLQLANVLYSKGFSITVFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESICEGVPMIFSDFGLDQPLNARYMSDVLKVGVRLENGWERGEIENAIRRVMVDEEGEVIRQNARVLKQKADVSLMKGGSSYESLESLVSYISSL

SEQ ID NO: 523 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgagagttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggcttggagcgtggtgaaatcgcgaacgcgattcgtcgtgtgatggttgacgaggaaggtgaggtgatgcgtcagaacgcgcgtgttctgaagcaaaaagcggatgttagcctgatgaagggtggcagcagctacgagagcctggaaagcctggttagctatattagcagcctg

SEQ ID NO: 524 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQAVGFPMLRVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGLERGEIANAIRRVMVDEEGEVMRQNARVLKQKADVSLMKGGSSYESLESLVSYISSL

SEQ ID NO: 525 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcgcctgaactgcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgtttggcgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 526 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGAPELRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVWREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADVSLMKGGSSYESLESLVSYISSL

SEQ ID NO: 527 - DNA, 1371 bp, Artificial Sequence
  ADP-Glycosyltransferase Variant of SEQ ID NO: 348
atggagaacaaaaccgaaaccaccgtgcgtcgtcgtcgtattattctgtttccggttccgttcccgggccacatcaacccgattctgcaactggcgaacgtgctgtacagcaagggttttagcatcaccatttttcacaccaacttcaacaagccgaaaccgagcaactatccgcacttcacctttcgttttatcttggacaacgatccgcaggacgagcgtattagcaacctgccgacccatggtccgggcgcgggtatgcgtatcccgatcattaacgagcacggcgcggatgaattacgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcttgtttaacttccacgcgctggtgagcctgccgcagtttgacgagctaggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatcttcagcgacttcggtctggatcagccgctgaacgcgcgttacatgagcgatgttttgaaagtgggcgttcgactggagaacggctgggagcgtggtgaaatcgcgaacgcgattcgtcgtctgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 528 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKPSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRLMVDEEGEVIRQNARVLKQKADVSLMKGGSSYESLESLVSYISSL

SEQ ID NO: 529 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtaaagagctggaattactgatgcgggcgagcgaggaagacgaggaagttagctgcctgattaccgatgcgctgtggtacttcgcgcaaccggtggcggacagcctgaatctgccgcgtctggttctgatgaccagcagcctgtttaacttccacgcgctggtgagcctgccgcagtttttagagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctggccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgaatgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcagaacgcgcgtgttctgaagcaaaaagcggatgaaagcctgatgaagggtggcagcagctacgagagcctggaaagcctggttagctatattagcagcctg

SEQ ID NO: 530 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRKELELLMRASEEDEEVSCLITDALWYFAQPVADSLNLPRLVLMTSSLFNFHALVSLPQFLELGYLDPDDKTRLEEQAVGFPMLKVKDIKSAYSNWQIAKEILGKMIKQTRASSGVIWNSFKELEESELETVIREIPAPSFLIPLPKHLAASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADESLMKGGSSYESLESLVSYISSL

SEQ ID NO: 531 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggtgccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatccttaacgagcacggcgcggatgaactgcgtcgtgagctggaattactgatgcgggcgagcgaggaagacgaggaagttgcgtgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgcctaagcacctgaccgcgagcagcagcagcctgctggaccacgatccgaccgtgtttcagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgattcgtcagaacgcgcgtgttctgaagcaaaaagcggatgttagcctgatgaagggtggcagcagctacgagagcctggaaagcctggttagctatattagcagcctg

SEQ ID NO: 532 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPILNEHGADELRRELELLMRASEEDEEVACLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADVSLMKGGSSYESLESLVSYISSL

SEQ ID NO: 533 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcagaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgcctaagcacctgaccgcgagcagcagcagcctgctggaccacgatccgaccgtgtttcagtggctggaccagcaaccgccgagcagcgtgctgtacgttagctttggcagccagagcgaggtggacgaaaaggaattcctggagattgcgcgtggtctggttgacagcaaacaatcgtttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtggcttctggacccacggcggttggaacggcaccctggagagcgtgtgcgaaggcgttccgatgatctttagcccattcggtctggatcagccgctgaacgcgcgttacatgagcgatgttctgaaagtgggcgttcgactggagaacggcttggagcgtggtgaaatcgcgaacgcgattcgtcgtgtgatggttgacgaggaaggtgaggtgatgcgtcagaacgcgcgtgttctgaagcaaaaagcggatgttagcctgatgaagggtggcagcagctacgagagcctggaaagcctggttagctatattagcagcctg

SEQ ID NO: 534 - protein, 457 aa, Artificial Sequence
  ADP-Glycosyltransferase Variant of SEQ ID NO: 348
MENKTETTVRRRRIILFPVPFPGHINPILQLANVLYSRGFSITIFHTNFNKPKTSNYPHFTFRFILDNDPQDERISNLPTHGPGAGMRIPIINEHGADELRRELELLMRASEEDEEVACLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHGAIGGFWTHGGWNGTLESVCEGVPMIFSPFGLDQPLNARYMSDVLKVGVRLENGLERGEIANAIRRVMVDEEGEVMRQNARVLKQKADVSLMKGGSSYESLESLVSYISSL

SEQ ID NO: 535 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcggattagcaacctgccgacccatggtccgggcgcgggtatgcgtatcccgatcattaacgagcacggcgcggatgaactgcgtcgtgagctggaattactgatgcgggcgagcgaggaagacgaggaagttagctgcctgattaccgatgcgctgtggtacttcgcgcaaccggtggcggacagcctggggctgccgcgtctggttctgatgaccagcagcctgtttaacttccacgcgctggtgagcctgccgcagtttgacgagcttggctacctggatccgggcgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcagaacgcgcgtgttctgaagcaaaaagcggatgttagcctgatgaagggtggcagcagctacgagagcctggaaagcctggttagctatattagcagcctg

SEQ ID NO: 536 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLGLPRLVLMTSSLFNFHALVSLPQFDELGYLDPGDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADVSLMKGGSSYESLESLVSYISSL

SEQ ID NO: 537 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggtgccgttcccgggccacatcaacccgattctgcaactggcgaacgtgctgtacagcagaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagtttcgtgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaagttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtggcttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggcttggagcgtggtgaaatcgcgaacgcgattcgtcgtgtgatggttgacgaggaaggtgaggtgatgcgtcagaacgcgcgtgttctgaagcaaaaagcggatgttagcctgatgaagggtggcagcagctacgagagcctggaaagcctggttagctatattagcagcctg

SEQ ID NO: 538 - protein, 457 aa, Artificial Sequence
  ADP-Glycosyltransferase Variant of SEQ ID NO: 348
MENKTETTVRRRRIILFPVPFPGHINPILQLANVLYSRGFSITIFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHGAIGGFWTHGGWNGTLESVCEGVPMIFSDFGLDQPLNARYMSDVLKVGVRLENGLERGEIANAIRRVMVDEEGEVMRQNARVLKQKADVSLMKGGSSYESLESLVSYISSL

SEQ ID NO: 539 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggacgaactgcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggatgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcaaaacgcgcgtgttctgaagcaaaaagcggatcaaagcctggccaagggtggcagcagctacgagagcctggaaagcctggttagctatattagcagcctt

SEQ ID NO: 540 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADQSLAKGGSSYESLESLVSYISSL

SEQ ID NO: 541 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggacgaactgcgtcgtgagctggaattactgatgcgggcgagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgatgtttgacgagcttggctacctggatccgtcggataaaaccggtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcagagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtgaaaacgcgcgtgttctgaagcaaaaagcggatgtcagcctggccaagggtggcagcagctacgagagcctggaaagcctggttagctatattagcagcctt

SEQ ID NO: 542 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVSCLITDALWYFAQPVADSLNLPRLVLMTSSLFNFHALVSLPMFDELGYLDPSDKTGLEEQAVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRENARVLKQKADVSLAKGGSSYESLESLVSYISSL

SEQ ID NO: 543 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcgggcgagcgaggaagacgaggaagttgcgtgcctgattaccgatgcgctgtggtacttcgcgcaaccggtggcggacagcctgaacctgccgcgtctggttctgatgaccagcagcctgtttaacttccacgcgctggtggcgctgccgcagtttgacgagcttggctacctggatccggacgataaaacccgtctggaggaacaagtggtaggtttcccgatgctgaaggttaaagatatcaagagcgcgtatagcaattggcagatcgcgaaagaaattctgggcaagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcccattcggtctggatcagccgctgaacgcgcgttacatgagcgatgttctgaaagtgggcgttcgactggagaacggcttggagcgtggtgaaatcgcgaacgcgattcgtcgtgtgatggttgacgaggaaggtgaggtgatgcgtcagaacgcgcgtgttctgaagcaaaaagcggatgttagcctgatgaagggtggcagcagctacgagagcctggaaagcctggttagctatattagcagcctg

SEQ ID NO: 544 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRASEEDEEVACLITDALWYFAQPVADSLNLPRLVLMTSSLFNFHALVALPQFDELGYLDPDDKTRLEEQVVGFPMLKVKDIKSAYSNWQIAKEILGKMIKQTRASSGVIWNSFKELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHGAIGAFWTHGGWNGTLESVCEGVPMIFSPFGLDQPLNARYMSDVLKVGVRLENGLERGEIANAIRRVMVDEEGEVMRQNARVLKQKADVSLMKGGSSYESLESLVSYISSL

SEQ ID NO: 545 - DNA, 1371 bp, Artificial Sequence
  ADP-Glycosyltransferase Variant of SEQ ID NO: 348
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaattactgatgcggggcagcgaggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcaatttgacgagcttggctacctggatccggacgataaaacccgtctggaggaacaagcggtaggtttcccgatgctgaaggttaaagatatcaagagcgcgtatagcaattggcagatcgcgaaagaaattctgggcaagatgattaagcagacccgtgcgagcagcggtgtgatttggaacagctttagagagctggaggaaagcgagctggaaaccgttatccgtgaaattccggcgccgagcttcctgattccgctgccgaagcacctgagggcgagcagcagcagcctgctggaccctgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggtggagcctctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgttcgactggagaacggctgggagcgtggtgaaatcgcgaacgcgattcgtcgtgtgatggttgacgaggaaggtgaggtgatccgtcagaacgcgcgtgttctgaagcaaaaagcggatggtagcctgatgaagggtggcagcagctacgagagcctggaaagcctggttagctatattagcagcctg

SEQ ID NO: 546 - protein, 457 aa, Artificial Sequence
  ADP-Glycosyltransferase Variant of SEQ ID NO: 348
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELELLMRGSEEDEEVSCLITDALWYFAQPVADSLNLPRLVLMTSSLFNFHALVSLPQFDELGYLDPDDKTRLEEQAVGFPMLKVKDIKSAYSNWQIAKEILGKMIKQTRASSGVIWNSFRELEESELETVIREIPAPSFLIPLPKHLRASSSSLLDPDPTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVRLENGWERGEIANAIRRVMVDEEGEVIRQNARVLKQKADGSLMKGGSSYESLESLVSYISSL

SEQ ID NO: 547 - DNA, 1371 bp, Artificial Sequence; identical to SEQ ID NO: 499
  ADP-Glycosyltransferase SEQ ID NO: 500 without histidine tag

SEQ ID NO: 548 - protein, 457 aa, Artificial Sequence; identical to SEQ ID NO: 500
  ADP-Glycosyltransferase SEQ ID NO: 500 without histidine tag

SEQ ID NO: 549 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggaattcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 550 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDEWISNLPTHGPGAGMRIPIINEHGADELRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 551 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccgtttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatccttaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggtagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtctgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 552 - protein, 457 aa, Artificial Sequence
  ADP-Glycosyltransferase Variant of SEQ ID NO: 548
MENKTETTVRRRRIILFPVPFPGHINPMLQLANVLYSKGFSITVFHTNFNKPKTSNYPHFTFRFILDNDPQDERISNLPTHGPGAGMRIPILNEHGADELRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFRELEESELETVIREIPAPSFLIPLPKHLTASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRLMVDREGEVIRQNAAVLKDKADVSLMKGGSSYESLESLVSYISSL

SEQ ID NO: 553 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgatgctgcaactggcgaacgtgctgtacagcaagggttttagcatcaccatttttcacaccaacttcaacaagccgaaaacgagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaatctgccgcgtctggttctgatgaccagcagcctgtttaacttccacgcgctggtggcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgacttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatccgtcagaacgcggcggttctgaaggataaagcggatgtgagcctgatgaagggtggcagcagctacgagagcctggaaagcctggttagctatattagcagcctg

SEQ ID NO: 554 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDEWISNLPTHGPGAGMRIPIINEHGADELRRELESLMRASPEDEEVSCLITDALWYFAQPVADSLNLPRLVLMTSSLFNFHALVALPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIENAIRRVMVDREGEVIRQNAAVLKDKADVSLMKGGSSYESLESLVSYISSL

SEQ ID NO: 555 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattacgtagagagctggaaagcctgatgcgggcgagcccggaagacgaggaagttagctgcctgattaccgatgcgctgtggtacttcgcgcaaccggtggcggacagcctgaatctgccgcgtctggttctgatgaccagcagcctgtttaacttccacgcgctggtggcgctgccgatgtttttagagcttggctacctggatccggacgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgacagcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcaaagcctggctaagggtggcagcagctacgagagcctggaaagcctggttagctatattagcagcctg

SEQ ID NO: 556 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDEWISNLPTHGPGAGMRIPIINEHGADELRRELESLMRASPEDEEVSCLITDALWYFAQPVADSLNLPRLVLMTSSLFNFHALVALPMFLELGYLDPDDKTRLEEQVVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIANAIRRVMVDREGEVIRQNAAVLKDKADQSLAKGGSSYESLESLVSYISSL

SEQ ID NO: 557 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatccttaacgagcacggcgcggatgaatttcgtaaagagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtggcttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgcaaacgcgattcgtcgtgtgatggttgaccgtgaaggtgaggtgatgcgtcaaaacgcggcggttctgaaggataaagcggatgttagcctgatgaagggtggcagcagctacgagagcctggaaagcctggttagctatattagcagcctg

SEQ ID NO: 558 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPILNEHGADEFRKELESLMRASPEDEEVSCLITDALWYFAQPVADSLNLPRLVLMTSSLFNFHALVSLPMFLELGYLDPDDKTRLEEQAVGFPMLKVKDIKSAYSNWQIAKEILDKMIKQTRASSGVIWNSFKELEESELETVWREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGGFWTHGGWNGTLESVCEGVPMIFSDFGLDQPLNARYMSDVLKVGVYLENGWERGEIANAIRRVMVDREGEVMRQNAAVLKDKADVSLMKGGSSYESLESLVSYISSL

SEQ ID NO: 559 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcccgttcggtctggatcagccgctgaacgcgcgttacatgagcgatgttctgaaagtgggcgtttatctggagaacggcttggagcgtggtgaaatcgcaaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 560 - protein, 457 aa, Artificial Sequence
  ADP-Glycosyltransferase Variant of SEQ ID NO: 548
MENKTETTVRRRRVILFPVPFPGHINPILQLANVLYSKGFSITIFHTNFNKPKTSNYPHFTFRFILDNDPQDEWISNLPTHGPGAGMRIPIINEHGADELRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGLERGEIANAIRRVMVDREGEVIRQNAAVLKDKADVSLMKGGSSYESLESLVSYISSL

SEQ ID NO: 561 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 562 - protein, 457 aa, Artificial Sequence
  ADP-Glycosyltransferase Variant of SEQ ID NO: 548
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 563 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatccttaacgagcacggcgcgccggaatttcgtaaagagctggaaagcctgatgcgggcgagcccggaagacgaggaagtttcgtgcctgattaccgatgcgctgtggtacttcgcgcaaccggtggcggacagcctgaatctgccgcgtctggttctgatgaccagcagcctgtttaacttccacgcgctggtggcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 564 - protein, 457 aa, Artificial Sequence
  ADP-Glycosyltransferase Variant of SEQ ID NO: 548
MENKTETTVRRRRIILFPVPFPGHINPMLQLANVLYSRGFSITIFHTNFNKPKTSNYPHFTFRFILDNDPQDERISNLPTHGPGAGMRIPILNEHGAPEFRKELESLMRASPEDEEVSCLITDALWYFAQPVADSLNLPRLVLMTSSLFNFHALVALPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 565 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatccttaacgagcacggcgcggatgaattccgtaaagagctggaaagcctgatgcgggccagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccgagtgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 566 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPILNEHGADEFRKELESLMRASPEDEEVSCLITDALWYFAQPVADSLNLPRLVLMTSSLFNFHALVSLPMFLELGYLDPSDKTRLEEQAVGFPMLKVKDIKSAYSNWQIAKEILDKMIKQTRASSGVIWNSFKELEESELETVWREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 567 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggccagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtggcgctgccgcaatttttagagcttggctacctggatccggacgataaaacccgtctggaggaacaagcggtaggtttcccgatgctgaaagttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatacgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaagcgatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgattcgtcaaaacgcggcggttctgaaggataaagcggatcaaagcctggctaagggtggcagcagctacgagagcctggaaagcctggttagctatattagcagcctg

SEQ ID NO: 568 - protein, 457 aa, Artificial Sequence
  ADP-Glycosyltransferase Variant of SEQ ID NO: 548
MENKTETTVRRRRIILFPVPFPGHINPMLQLANVLYSKGFSITVFHTNFNKPKTSNYPHFTFRFILDNDPQDERISNLPTHGPGAGMRIPIINEHGADELRRELESLMRASPEDEEVACLITDALWYFAQPVADSLNLPRLVLMTSSLFNFHALVALPQFLELGYLDPDDKTRLEEQAVGFPMLKVKDIKSAYSNWQIAKEILDKMIKQTRASSGVIWNSFRELEESELETVIREIPAPSFLIPLPKHLTASSSSLLDHDPTVFQWLDQQPPSSVLYVSFGSQSEVDESDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADQSLAKGGSSYESLESLVSYISSL

SEQ ID NO: 569 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatccttaacgagcacggcgcggatgaatttcgtaaagagctggaaagcctgatgcggggcagcccggaagacgaggaagttagctgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgagagttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctggcagcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcccgttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcaaagcctgatgaagggtggcagcagctacgagagcctggaaagcctggttagctatattagcagcctg

SEQ ID NO: 570 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDERISNLPTHGPGAGMRIPILNEHGADEFRKELESLMRGSPEDEEVSCLITDALWYFAQPVADSLNLPRLVLMTSSLFNFHALVSLPQFLELGYLDPDDKTRLEEQAVGFPMLRVKDIKSAYSNWQIAKEILDKMIKQTRASSGVIWNSFKELEESELETVIREIPAPSFLIPLPKHLAASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGWERGEIANAIRRVMVDREGEVIRQNAAVLKDKADQSLMKGGSSYESLESLVSYISSL

SEQ ID NO: 571 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaaaggttttagcatcaccgtttttcacaccaacttcaacaagccgaaaaccagcaactatccgcacttcacctttcgttttatcttggacaacgatccgcaggacgagcgtattagcaacctgccgacccatggtccgggcgcgggtatgcgtattccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgagtgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 572 - protein, 457 aa, Artificial Sequence
  ADP-Glycosyltransferase Variant of SEQ ID NO: 548
MENKTETTVRRRRVILFPVPFPGHINPMLQLANVLYSKGFSITVFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFLELGYLDPSDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 573 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaatctgccgcgtctggttctgatgaccagcagcctgtttaacttccacgcgctggtggcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgcgaaattccggcgccgagcttcctgattccgctgccgaagcacctgaccgcgagcagcagcagcctgctggactccgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtttgcgaaggcgttccgatgatctttagcgatttcggtctggatcagccgctgaacgcgcgttacatgagcgatgttctgaaagtgggcgtttatctggagaacggctgggagcgtggtgaaatcgcaaacgcgattcgtcgtgtgatggttgaccgtgaaggtgaggtgatccgtcagaacgcggcggttctgaaggataaagcggatcgaagcctgatgaagggtggcagcagctacgagagcctggaaagcctggttagctatattagcagcctg

SEQ ID NO: 574 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVALPQFLELGYLDPDDKTRLEEQAVGFPMLKVKDIKSAYSNWQIAKEILDKMIKQTRASSGVIWNSFKELEESELETVWREIPAPSFLIPLPKHLTASSSSLLDSDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADRSLMKGGSSYESLESLVSYISSL

SEQ ID NO: 575 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaccgagcaactatccgcacttcacctttcgttttatcttggacaacgatccgcaggacgagcggattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgagagttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtctgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 576 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKPSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFLELGYLDPDDKTRLEEQAVGFPMLRVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRLMVDREGEVIRQNAAVLKDKADVSLMKGGSSYESLESLVSYISSL

SEQ ID NO: 577 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatcattaacgagcacggcgcggatgaattccgtaaagagctggaaagcctgatgcggggcagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgaccgcgagcagcagcagcctgctggactccgatccgaccgtgttccagtggctggaccagcaaccgccgagcagcgtgctgtacgttagctttggcagccagagcgaggtggacgaaaaggaattcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtggcttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcaaagcctgatgaagggtggcagcagctacgagagcctggaaagcctggttagctatattagcagcctg

SEQ ID NO: 578 - protein, 457 aa, Artificial Sequence
  ADP-Glycosyltransferase Variant of SEQ ID NO: 548
MENKTETTVRRRRVILFPVPFPGHINPMLQLANVLYSRGFSITIFHTNFNKPKTSNYPHFTFRFILDNDPQDERISNLPTHGPGAGMRIPIINEHGADEFRKELESLMRGSPEDEEVSCLITDALWYFAQPVADSLNLPRLVLMTSSLFNFHALVSLPMFLELGYLDPDDKTRLEEQAVGFPMLKVKDIKSAYSNWQIAKEILDKMIKQTRASSGVIWNSFKELEESELETVWREIPAPSFLIPLPKHLTASSSSLLDSDPTVFQWLDQQPPSSVLYVSFGSQSEVDEKEFLEIARGLVQSKQSFLWRVRPGFVKGSEWVEPLPDGFLGERGRIVKSVPQQEVLAHDAIGGFWTHGGWNGTLESVCEGVPMIFSDFGLDQPLNARYMSDVLKVGVYLENGWERGEIANAIRRVMVDREGEVIRQNAAVLKDKADQSLMKGGSSYESLESLVSYISSL

SEQ ID NO: 579 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaattacgtagagagctggaaagcctgatgcgggccagcccggaagacgaggaagttagctgcctgattaccgatgcgctgtggtacttcgcgcaaccggtggcggacagcctgaacctgccgcgtctggttctgatgaccagcagcctgtttaacttccacgcgctggtggcgctgccgcaatttttagagcttggctacctggatccggacgataaaacccgtctggaggaacaagcggtaggtttcccgatgctgagagttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcgaagcctggctaagggtggcagcagctacgagagcctggaaagcctggttagctatattagcagcctg

SEQ ID NO: 580 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVALPQFLELGYLDPDDKTRLEEQAVGFPMLRVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADRSLAKGGSSYESLESLVSYISSL

SEQ ID NO: 581 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgatgctgcaactggcgaacgtgctgtacagcaaaggttttagcatcaccatttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatccttaacgagcacggcgcgccggaatttcgtagagagctggaaagcctgatgcggggcagcccggaagacgaggaagttagctgcctgattaccgatgcgctgtggtacttcgcgcaaccggtggcggacagcctgaacctgccgcgtctggttctgatgaccagcagcctgtttaacttccacgcgctggtggcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggcttggagcgtggtgaaatcgcaaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 582 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDERISNLPTHGPGAGMRIPILNEHGAPEFRRELESLMRGSPEDEEVSCLITDALWYFAQPVADSLNLPRLVLMTSSLFNFHALVALPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIANAIRRVMVDREGEVIRQNAAVLKDKADVSLMKGGSSYESLESLVSYISSL

SEQ ID NO: 583 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatcattaacgagcacggcgcgccggaatttcgtaaagagctggaaagcctgatgcgggcgagcccggaagacgaggaagttagctgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgagagttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtggcttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggcttggagcgtggtgaaatcgcgaacgcgattcgtcgtgtgatggttgaccgtgaaggtgaggtgatccgtcagaacgcggcggttctgaaggataaagcggatgagagcctggctaagggtggcagcagctacgagagcctggaaagcctggttagctatattagcagcctg

SEQ ID NO: 584 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDERISNLPTHGPGAGMRIPIINEHGAPEFRKELESLMRASPEDEEVSCLITDALWYFAQPVADSLNLPRLVLMTSSLFNFHALVSLPQFLELGYLDPDDKTRLEEQAVGFPMLRVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGGFWTHGGWNGTLESVCEGVPMIFSDFGLDQPLNARYMSDVLKVGVYLENGLERGEIANAIRRVMVDREGEVIRQNAAVLKDKADESLAKGGSSYESLESLVSYISSL

SEQ ID NO: 585 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaaaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaattccgtagagagctggaaagcctgatgcgggcgagcccggaagacgaggaagttagctgcctgattaccgatgcgctgtggtacttcgcgcaaccggtggcggacagcctgggactgccgcgtctggttctgatgaccagcagcctgtttaacttccacgcgctggtggcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatccgtgaaattccggcgccgagcttcctgattccgctgccgaagcacctgacagcgagcagcagcagcctgctggactccgatccgaccgtgttccagtggctggaccagcaaccgccgagcagcgtgctgtacgttagctttggcagccagagcgaggtggacgaaagcgatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgacttcggtctggatcagccgctgaacgcgcgttacatgagcgatgttctgaaagtgggcgtttatctggagaacggcttggagcgtggtgaaatcgcgaacgcgattcgtcgtgtgatggttgaccgtgaaggtgaggtgatccgtcagaacgcggcggttctgaaggataaagcggatcgaagcctggctaagggtggcagcagctacgagagcctggaaagcctggttagctatattagcagcctg

SEQ ID NO: 586 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPIINEHGADEFRRELESLMRASPEDEEVSCLITDALWYFAQPVADSLGLPRLVLMTSSLFNFHALVALPQFLELGYLDPDDKTRLEEQAVGFPMLKVKDIKSAYSNWQIAKEILDKMIKQTRASSGVIWNSFRELEESELETVIREIPAPSFLIPLPKHLTASSSSLLDSDPTVFQWLDQQPPSSVLYVSFGSQSEVDESDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGLERGEIANAIRRVMVDREGEVIRQNAAVLKDKADRSLAKGGSSYESLESLVSYISSL

SEQ ID NO: 587 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaacgagcaactatccgcacttcacctttcgttttatcttggacaacgatccgcaggacgagcggattagcaacctgccgacccatggtccgggcgcgggtatgcgtatcccgatccttaacgagcacggcgcggatgaatttcgtagagagctggaaagcctgatgcgggcgagcccggaagacgaggaagttagctgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgtttggcgtgaaattccggcgccgagcttcctgattccgctgccgaagcacctgaccgcgagcagcagcagcctgctggaccatgatccgaccgtgttccagtggctggaccagcaaccgccgagcagcgtgctgtacgttagctttggcagccagagcgaggtggacgaaagcgatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtttgcgaaggcgttccgatgatctttagcgatttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 588 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPILNEHGADEFRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFRELEESELETVWREIPAPSFLIPLPKHLTASSSSLLDHDPTVFQWLDQQPPSSVLYVSFGSQSEVDESDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 589 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaaaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaattacgtaaagagctggaaagcctgatgcgggccagcccggaagacgaggaagttagctgcctgattaccgatgcgctgtggtacttcgcgcaaccggtggcggacagcctgggactgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgaaagttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatgcgtgaaaacgcggcggttctgaaggataaagcggatgttagcctgatgaagggtggcagcagctacgagagcctggaaagcctggttagctatattagcagcctg

SEQ ID NO: 590 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGADELRKELESLMRASPEDEEVSCLITDALWYFAQPVADSLGLPRLVLMTSSLFNFHALVSLPMFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVMRENAAVLKDKADVSLMKGGSSYESLESLVSYISSL

SEQ ID NO: 591 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaattccgtagagagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtggcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 592 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPIINEHGADEFRRELESLMRASPEDEEVSCLITDALWYFAQPVADSLNLPRLVLMTSSLFNFHALVALPQFLELGYLDPDDKTRLEEQAVGFPMLKVKDIKSAYSNWQIAKEILDKMIKQTRASSGVIWNSFKELEESELETVIREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 593 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaacgagcaactatccgcacttcacctttcgttttatcttggacaacgatccgcaggacgagtggattagcaacctgccgacccatggtccgggcgcgggtatgcgtatcccgatcattaacgagcacggcgcgccggaattccgtaaagagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaaccggtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctggcagcgagcagcagcagcctgctggactccgatccgaccgtgttccagtggctggaccagcaaccgccgagcagcgtgctgtacgttagctttggcagccagagcgaggtggacgaaaaggaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 594 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDEWISNLPTHGPGAGMRIPIINEHGAPEFRKELESLMRASPEDEEVSCLITDALWYFAQPVADSLNLPRLVLMTSSLFNFHALVSLPQFLELGYLDPDDKTGLEEQVVGFPMLKVKDIKSAYSNWQIAKEILDKMIKQTRASSGVIWNSFKELEESELETVWREIPAPSFLIPLPKHLAASSSSLLDSDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVIRQNAAVLKDKADVSLMKGGSSYESLESLVSYISSL

SEQ ID NO: 595 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcggggcagcccggaagacgaggaagttagctgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatccgtgaaattccggcgccgagcttcctgattccgctgccgaagcacctgaccgcgagcagcagcagcctgctggaccatgatccgaccgtgttccagtggctggaccagcaaccgccgagcagcgtgctgtacgttagctttggcagccagagcgaggtggacgaaagcgatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtttgcgaaggcgttccgatgatctttagcgacttcggtctggatcagccgctgaacgcgcgttacatgagcgatgttctgaaagtgggcgtttatctggagaacggcttggagcgtggtgaaatcgcgaacgcgattcgtcgtgtgatggttgaccgtgaaggtgaggtgattcgtcaaaacgcggcggttctgaaggataaagcggatgtgagcctgatgaagggtggcagcagctacgagagcctggaaagcctggttagctatattagcagcctg

SEQ ID NO: 596 - protein, 457 aa, Artificial Sequence
  ADP-Glycosyltransferase Variant of SEQ ID NO: 548
MENKTETTVRRRRVILFPVPFPGHINPMLQLANVLYSRGFSITIFHTNFNKPKTSNYPHFTFRFILDNDPQDERISNLPTHGPGAGMRIPIINEHGADELRRELESLMRGSPEDEEVSCLITDALWYFAQPVADSLGLPRLVLMTSSLFNFHALVSLPQFLELGYLDPDDKTRLEEQAVGFPMLKVKDIKSAYSNWQIAKEILDKMIKQTRASSGVIWNSFRELEESELETVIREIPAPSFLIPLPKHLTASSSSLLDHDPTVFQWLDQQPPSSVLYVSFGSQSEVDESDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIANAIRRVMVDREGEVIRQNAAVLKDKADVSLMKGGSSYESLESLVSYISSL

SEQ ID NO: 597 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaccgagcaactatccgcacttcacctttcgttttatcttggacaacgatccgcaggacgagcgtattagcaacctgccgacccatggtccgggcgcgggtatgcgtatcccgatccttaacgagcacggcgcggatgaattacgtagagagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 598 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKPSNYPHFTFRFILDNDPQDERISNLPTHGPGAGMRIPILNEHGADELRRELESLMRASPEDEEVSCLITDALWYFAQPVADSLNLPRLVLMTSSLFNFHALVSLPMFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 599 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcgccggaattacgtaaagagctggaaagcctgatgcgggcgagcccggaagacgaggaagttagctgcctgattaccgatgcgctgtggtacttcgcgcaaccggtggcggacagcctgggactgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgagagttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatccgtgaaattccggcgccgagcttcctgattccgctgccgaagcacctggcagcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 600 - protein, 457 aa, Artificial Sequence
  ADP-Glycosyltransferase Variant of SEQ ID NO: 548
MENKTETTVRRRRVILFPVPFPGHINPMLQLANVLYSKGFSITVFHTNFNKPKTSNYPHFTFRFILDNDPQDEWISNLPTHGPGAGMRIPIINEHGAPELRKELESLMRASPEDEEVSCLITDALWYFAQPVADSLGLPRLVLMTSSLFNFHALVSLPMFLELGYLDPDDKTRLEEQAVGFPMLRVKDIKSAYSNWQIAKEILDKMIKQTRASSGVIWNSFRELEESELETVIREIPAPSFLIPLPKHLAASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 601 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatcattaacgagcacggcgcggatgaattacgtaaagagctggaaagcctgatgcgggcgagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgagagttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatccgtgaaattccggcgccgagcttcctgattccgctgccgaagcacctgagggcgagcagcagcagcctgctggaccccgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgccttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggcttggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 602 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPIINEHGADELRKELESLMRASPEDEEVACLITDALWYFAQPVADSLGLPRLVLMTSSLFNFHALVSLPQFLELGYLDPDDKTRLEEQAVGFPMLRVKDIKSAYSNWQIAKEILDKMIKQTRASSGVIWNSFRELEESELETVIREIPAPSFLIPLPKHLRASSSSLLDPDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIANAIRRVMVDREGEVIRQNAAVLKDKADVSLMKGGSSYESLESLVSYISSL

SEQ ID NO: 603 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggccagcccggaagacgaggaagttagctgcctgattaccgatgcgctgtggtacttcgcgcaaccggtggcggacagcctgaatctgccgcgtctggttctgatgaccagcagcctgtttaacttccacgcgctggtgtcgctgccgatgtttttagagcttggctacctggatccggacgataaaacccgtctggaggaacaagcggtaggtttcccaatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatccgtgaaattccggcgccgagcttcctgattccgctgccgaagcacctgacagcgagcagcagcagcctgctggaccatgatccgaccgtgttccagtggctggaccagcaaccgccgagcagcgtgctgtacgttagctttggcagccagagcgaggtggacgaaaaggaattcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtttgcgaaggcgttccgatgatctttagcccgttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 604 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPMFLELGYLDPDDKTRLEEQAVGFPMLKVKDIKSAYSNWQIAKEILDKMIKQTRASSGVIWNSFRELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGWERGEIENAIRRVMVDREGEVIRQNAAVLKDKADVSLMKGGSSYESLESLVSYISSL

SEQ ID NO: 605 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcggggcagcccggaagacgaggaagttagctgcctgattaccgatgcgctgtggtacttcgcgcaaccggtggcggacagcctgaatctgccgcgtctggttctgatgaccagcagcctgtttaacttccacgcgctggtggcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcccgttcggtctggatcagccgctgaacgcgcgttacatgagcgatgttctgaaagtgggcgtttatctggagaacggcttggagcgtggtgaaatcgcaaacgcgattcgtcgtgtgatggttgaccgtgaaggtgaggtgatccgtcagaacgcggcggttctgaaggataaagcggatgagagcctggctaagggtggcagcagctacgagagcctggaaagcctggttagctatattagcagcctg

SEQ ID NO: 606 - protein, 457 aa, Artificial Sequence
  ADP-Glycosyltransferase Variant of SEQ ID NO: 548
MENKTETTVRRRRVILFPVPFPGHINPILQLANVLYSKGFSITIFHTNFNKPKTSNYPHFTFRFILDNDPQDERISNLPTHGPGAGMRIPIINEHGADELRRELESLMRGSPEDEEVSCLITDALWYFAQPVADSLNLPRLVLMTSSLFNFHALVALPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGLERGEIANAIRRVMVDREGEVIRQNAAVLKDKADESLAKGGSSYESLESLVSYISSL

SEQ ID NO: 607 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcaagggttttagcatcaccatttttcacaccaacttcaacaagccgaaaacgagcaactatccgcacttcacctttcgttttatcttggacaacgatccgcaggacgagcggattagcaacctgccgacccatggtccgggcgcgggtatgcgtatcccgatccttaacgagcacggcgcgccggaatttcgtagagagctggaaagcctgatgcgggcgagcccggaagacgaggaagtttcgtgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccccgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatgcgtgaaaacgcggcggttctgaaggataaagcggatcgaagcctgatgaagggtggcagcagctacgagagcctggaaagcctggttagctatattagcagcctg

SEQ ID NO: 608 - protein, 457 aa, Artificial Sequence
  ADP-Glycosyltransferase Variant of SEQ ID NO: 548
MENKTETTVRRRRVILFPVPFPGHINPILQLANVLYSKGFSITIFHTNFNKPKTSNYPHFTFRFILDNDPQDERISNLPTHGPGAGMRIPILNEHGAPEFRRELESLMRASPEDEEVSCLITDALWYFAQPVADSLNLPRLVLMTSSLFNFHALVSLPMFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDPDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIANAIRRVMVDREGEVMRENAAVLKDKADRSLMKGGSSYESLESLVSYISSL

SEQ ID NO: 609 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcagaggttttagcatcaccatttttcacaccaacttcaacaagccgaaaaccagcaactatccgcacttcacctttcgttttatcttggacaacgatccgcaggacgagcggattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcaaacgcgattcgtcgtgtgatggttgaccgtgaaggtgaggtgatccgtcagaacgcggcggttctgaaggataaagcggatgtgagcctggctaagggtggcagcagctacgagagcctggaaagcctggttagctatattagcagcctg

SEQ ID NO: 610 - protein, 457 aa, Artificial Sequence
  ADP-Glycosyltransferase Variant of SEQ ID NO: 548
MENKTETTVRRRRIILFPVPFPGHINPILQLANVLYSRGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLAKGGSSYESLESLVSYISSL

SEQ ID NO: 611 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtggcgctgccgcaatttttagagcttggctacctggatccggacgataaaaccggtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgattcgtgaaaacgcggcggttctgaaggataaagcggatgagagcctgatgaagggtggcagcagctacgagagcctggaaagcctggttagctatattagcagcctg

SEQ ID NO: 612 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDEWISNLPTHGPGAGMRIPIINEHGADELRRELESLMRASPEDEEVSCLITDALWYFAQPVADSLNLPRLVLMTSSLFNFHALVALPQFLELGYLDPDDKTGLEEQVVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRENAAVLKDKADESLMKGGSSYESLESLVSYISSL

SEQ ID NO: 613 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcgccggaatttcgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtggcgctgccgatgtttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgagagcctggctaagggtggcagcagctacgagagcctggaaagcctggttagctatattagcagcctg

SEQ ID NO: 614 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDEWISNLPTHGPGAGMRIPIINEHGAPEFRKELESLMRASPEDEEVACLITDALWYFAQPVADSLNLPRLVLMTSSLFNFHALVALPMFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADESLAKGGSSYESLESLVSYISSL

SEQ ID NO: 615 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgagagcctggctaagggtggcagcagctacgagagcctggaaagcctggttagctatattagcagcctg

SEQ ID NO: 616 - protein, 457 aa, Artificial Sequence
  ADP-Glycosyltransferase Variant of SEQ ID NO: 548
MENKTETTVRRRRVILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPMFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIANAIRRVMVDREGEVIRQNAAVLKDKADESLAKGGSSYESLESLVSYISSL

SEQ ID NO: 617 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagtttcgtgcctgattaccgatgcgctgtggtacttcgcgcaaccggtggcggacagcctgggactgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgagagttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtggcttctggacccacggcggttggaacggcaccctggagagcatttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcaaagcctgatgaagggtggcagcagctacgagagcctggaaagcctggttagctatattagcagcctg

SEQ ID NO: 618 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLGLPRLVLMTSSLFNFHALVSLPMFLELGYLDPDDKTRLEEQAVGFPMLRVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGGFWTHGGWNGTLESICEGVPMIFSDFGLDQPLNARYMSDVLKVGVYLENGWERGEIANAIRRVMVDREGEVIRQNAAVLKDKADQSLMKGGSSYESLESLVSYISSL

SEQ ID NO: 619 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtcgtgagctggaaagcctgatgcggggcagcccggaagacgaggaagttagctgcctgattaccgatgcgctgtggtacttcgcgcaaccggtggcggacagcctgaatctgccgcgtctggttctgatgaccagcagcctgtttaacttccacgcgctggtgtcgctgccgatgtttttagagcttggctacctggatccgggtgataaaaccggtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctggcagcgagcagcagcagcctgctggaccccgatccgaccgtgttccagtggctggaccagcaaccgccgagcagcgtgctgtacgttagctttggcagccagagcgaggtggacgaaaaggaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgccttctggacccacggcggttggaacggcaccctggagagcgtttgcgaaggcgttccgatgatctttagcccgttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcagaacgcggcggttctgaaggataaagcggatgttagcctgatgaagggtggcagcagctacgagagcctggaaagcctggttagctatattagcagcctg

SEQ ID NO: 620 - protein, 457 aa, Artificial Sequence
  ADP-Glycosyltransferase Variant of SEQ ID NO: 548
MENKTETTVRRRRVILFPVPFPGHINPILQLANVLYSKGFSITIFHTNFNKPKTSNYPHFTFRFILDNDPQDEWISNLPTHGPGAGMRIPIINEHGADELRRELESLMRGSPEDEEVSCLITDALWYFAQPVADSLNLPRLVLMTSSLFNFHALVSLPMFLELGYLDPGDKTGLEEQAVGFPMLKVKDIKSAYSNWQIAKEILDKMIKQTRASSGVIWNSFKELEESELETVIREIPAPSFLIPLPKHLAASSSSLLDPDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGWERGEIENAIRRVMVDREGEVMRQNAAVLKDKADVSLMKGGSSYESLESLVSYISSL

SEQ ID NO: 621 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatccgtgaaattccggcgccgagcttcctgattccgctgccgaagcacctgagggcgagcagcagcagcctgctggactccgatccgaccgtgttccagtggctggaccagcaaccgccgagcagcgtgctgtacgttagctttggcagccagagcgaggtggacgaaagcgatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcccgttcggtctggatcagccgctgaacgcgcgttacatgagcgatgttctgaaagtgggcgtttatctggagaacggcttggagcgtggtgaaatcgcaaacgcgattcgtcgtctgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 622 - protein, 457 aa, Artificial Sequence
  ADP-Glycosyltransferase Variant of SEQ ID NO: 548
MENKTETTVRRRRVILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFRELEESELETVIREIPAPSFLIPLPKHLRASSSSLLDSDPTVFQWLDQQPPSSVLYVSFGSQSEVDESDFLEIARGLVDSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGLERGEIANAIRRLMVDREGEVIRQNAAVLKDKADVSLMKGGSSYESLESLVSYISSL

SEQ ID NO: 623 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaaaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgacagcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgccttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggcttggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 624 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPMFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIANAIRRVMVDREGEVIRQNAAVLKDKADVSLMKGGSSYESLESLVSYISSL

SEQ ID NO: 625 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaagggttttagcatcaccgtttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggccagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgggagcctggctaagggtggcagcagctacgagagcctggaaagcctggttagctatattagcagcctg

SEQ ID NO: 626 - protein, 457 aa, Artificial Sequence
  ADP-Glycosyltransferase Variant of SEQ ID NO: 548
MENKTETTVRRRRIILFPVPFPGHINPILQLANVLYSKGFSITVFHTNFNKPKTSNYPHFTFRFILDNDPQDEWISNLPTHGPGAGMRIPIINEHGADEFRKELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFKELEESELETVWREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIANAIRRVMVDREGEVIRQNAAVLKDKADGSLAKGGSSYESLESLVSYISSL

SEQ ID NO: 627 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgattcgtcaaaacgcggcggttctgaaggataaagcggatgttagcctgatgaagggtggcagcagctacgagagcctggaaagcctggttagctatattagcagcctg

SEQ ID NO: 628 - protein, 457 aa, Artificial Sequence
  ADP-Glycosyltransferase Variant of SEQ ID NO: 548
MENKTETTVRRRRVILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 629 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggcttggagcgtggtgaaatcgcgaacgcgattcgtcgtgtgatggttgaccgtgaaggtgaggtgattcgtcaaaacgcggcggttctgaaggataaagcggatgttagcctgatgaagggtggcagcagctacgagagcctggaaagcctggttagctatattagcagcctg

SEQ ID NO: 630 - protein, 457 aa, Artificial Sequence
  ADP-Glycosyltransferase Variant of SEQ ID NO: 548
MENKTETTVRRRRIILFPVPFPGHINPMLQLANVLYSKGFSITVFHTNFNKPKTSNYPHFTFRFILDNDPQDEWISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIANAIRRVMVDREGEVIRQNAAVLKDKADVSLMKGGSSYESLESLVSYISSL

SEQ ID NO: 631 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatacgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcaaagcctggctaagggtggcagcagctacgagagcctggaaagcctggttagctatattagcagcctg

SEQ ID NO: 632 - protein, 457 aa, Artificial Sequence
  ADP-Glycosyltransferase Variant of SEQ ID NO: 548
MENKTETTVRRRRVILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFRELEESELETVIREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADQSLAKGGSSYESLESLVSYISSL

SEQ ID NO: 633 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgattctgcaactggcgaacgtgctgtacagcaagggttttagcatcaccatttttcacaccaacttcaacaagccgaaaacgagcaactatccgcacttcacctttcgttttatcttggacaacgatccgcaggacgagtggattagcaacctgccgacccatggtccgggcgcgggtatgcgtatcccgatcattaacgagcacggcgcgccggaattccgtaaagagctggaaagcctgatgcggggcagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccggacgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaagcgaattcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgagagcctggctaagggtggcagcagctacgagagcctggaaagcctggttagctatattagcagcctg

SEQ ID NO: 634 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDEWISNLPTHGPGAGMRIPIINEHGAPEFRKELESLMRGSPEDEEVACLITDALWYFAQPVADSLNLPRLVLMTSSLFNFHALVSLPQFLELGYLDPDDKTRLEEQVVGFPMLKVKDIKSAYSNWQIAKEILDKMIKQTRASSGVIWNSFKELEESELETVIREIPAPSFLIPLPKHLRASSSSLLDHDPTVFQWLDQQPPSSVLYVSFGSQSEVDESEFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADESLAKGGSSYESLESLVSYISSL

SEQ ID NO: 635 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaatctgccgcgtctggttctgatgaccagcagcctgtttaacttccacgcgctggtggcgctgccgatgtttttagagcttggctacctggatccgagtgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 636 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVALPMFLELGYLDPSDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 637 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcagaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaatttcgtaaagagctggaaagcctgatgcgggcgagcccggaagacgaggaagttagctgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccggacgataaaaccggtctggaggaacaagtggtaggtttcccgatgctgaaagttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatacgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcccgttcggtctggatcagccgctgaacgcgcgttacatgagcgatgttctgaaagtgggcgtttatctggagaacggcttggagcgtggtgaaatcgcgaacgcgattcgtcgtctgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 638 - protein, 457 aa, Artificial Sequence
  ADP-Glycosyltransferase Variant of SEQ ID NO: 548
MENKTETTVRRRRVILFPVPFPGHINPILQLANVLYSRGFSITIFHTNFNKPKTSNYPHFTFRFILDNDPQDERISNLPTHGPGAGMRIPIINEHGADEFRKELESLMRASPEDEEVSCLITDALWYFAQPVADSLNLPRLVLMTSSLFNFHALVSLPQFLELGYLDPDDKTGLEEQVVGFPMLKVKDIKSAYSNWQIAKEILDKMIKQTRASSGVIWNSFRELEESELETVIREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGLERGEIANAIRRLMVDREGEVIRQNAAVLKDKADVSLMKGGSSYESLESLVSYISSL

SEQ ID NO: 639 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatcattaacgagcacggcgcgccggaattccgtagagagctggaaagcctgatgcgggcgagcccggaagacgaggaagtttcgtgcctgattaccgatgcgctgtggtacttcgcgcaaccggtggcggacagcctgaatctgccgcgtctggttctgatgaccagcagcctgtttaacttccacgcgctggtggcgctgccgatgtttttagagcttggctacctggatccggacgataaaacccgtctggaggaacaagtggtaggtttcccgatgctgaaagttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggactccgatccgaccgtgttccagtggctggaccagcaaccgccgagcagcgtgctgtacgttagctttggcagccagagcgaggtggacgaaagcgaattcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtggcttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatgcgtcaaaacgcggcggttctgaaggataaagcggatgttagcctgatgaagggtggcagcagctacgagagcctggaaagcctggttagctatattagcagcctg

SEQ ID NO: 640 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGAPEFRRELESLMRASPEDEEVSCLITDALWYFAQPVADSLNLPRLVLMTSSLFNFHALVALPMFLELGYLDPDDKTRLEEQVVGFPMLKVKDIKSAYSNWQIAKEILDKMIKQTRASSGVIWNSFKELEESELETVIREIPAPSFLIPLPKHLTASSSSLLDSDPTVFQWLDQQPPSSVLYVSFGSQSEVDESEFLEIARGLVDSKQSFLWRVRPGFVKGSEWVEPLPDGFLGERGRIVKSVPQQEVLAHDAIGGFWTHGGWNGTLESVCEGVPMIFSDFGLDQPLNARYMSDVLKVGVYLENGWERGEIANAIRRVMVDREGEVMRQNAAVLKDKADVSLMKGGSSYESLESLVSYISSL

SEQ ID NO: 641 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgattctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtcgtgagctggaaagcctgatgcggggcagcccggaagacgaggaagttagctgcctgattaccgatgcgctgtggtacttcgcgcaaccggtggcggacagcctgaacctgccgcgtctggttctgatgaccagcagcctgtttaacttccacgcgctggtggcgctgccgcaatttttagagcttggctacctggatccggacgataaaaccggtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 642 - protein, 457 aa, Artificial Sequence
  ADP-Glycosyltransferase Variant of SEQ ID NO: 548
MENKTETTVRRRRVILFPVPFPGHINPILQLANVLYSRGFSITIFHTNFNKPKTSNYPHFTFRFILDNDPQDEWISNLPTHGPGAGMRIPIINEHGADELRRELESLMRGSPEDEEVSCLITDALWYFAQPVADSLNLPRLVLMTSSLFNFHALVALPQFLELGYLDPDDKTGLEEQVVGFPMLKVKDIKSAYSNWQIAKEILDKMIKQTRASSGVIWNSFRELEESELETVIREIPAPSFLIPLPKHLTASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 643 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcggattagcaacctgccgacccatggtccgggcgcgggtatgcgtatcccgatcattaacgagcacggcgcgccggaatttcgtagagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 644 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGAPEFRRELESLMRASPEDEEVACLITDALWYFAQPVADSLNLPRLVLMTSSLFNFHALVSLPMFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 645 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaaaggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatccttaacgagcacggcgcggatgaatttcgtaaagagctggaaagcctgatgcgggcgagcccggaagacgaggaagttagctgcctgattaccgatgcgctgtggtacttcgcgcaaccggtggcggacagcctgaatctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatgcgtgaaaacgcggcggttctgaaggataaagcggatcaaagcctgatgaagggtggcagcagctacgagagcctggaaagcctggttagctatattagcagcctg

SEQ ID NO: 646 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPILNEHGADEFRKELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVMRENAAVLKDKADQSLMKGGSSYESLESLVSYISSL

SEQ ID NO: 647 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgatgtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcaaagcctgatgaagggtggcagcagctacgagagcctggaaagcctggttagctatattagcagcctg

SEQ ID NO: 648 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPMFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIANAIRRVMVDREGEVIRQNAAVLKDKADQSLMKGGSSYESLESLVSYISSL

SEQ ID NO: 649 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatccttaacgagcacggcgcggatgaattacgtagagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgatgtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttagagagctggaggaaagcgagctggaaaccgttatacgtgaaattccggcgccgagcttcctgattccgctgccgaagcacctgagggcgagcagcagcagcctgctggaccccgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 650 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDERISNLPTHGPGAGMRIPILNEHGADELRRELESLMRASPEDEEVACLITDALWYFAQPVADSLNLPRLVLMTSSLFNFHALVSLPMFDELGYLDPDDKTRLEEQAVGFPMLKVKDIKSAYSNWQIAKEILDKMIKQTRASSGVIWNSFRELEESELETVIREIPAPSFLIPLPKHLRASSSSLLDPDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVIRQNAAVLKDKADVSLMKGGSSYESLESLVSYISSL

SEQ ID NO: 651 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaacgagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggactccgatccgaccgtgttccagtggctggaccagcaaccgccgagcagcgtgctgtacgttagctttggcagccagagcgaggtggacgaaagcgatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcgaagcctggctaagggtggcagcagctacgagagcctggaaagcctggttagctatattagcagcctg

SEQ ID NO: 652 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFLELGYLDPDDKTRLEEQAVGFPMLKVKDIKSAYSNWQIAKEILDKMIKQTRASSGVIWNSFKELEESELETVIREIPAPSFLIPLPKHLTASSSSLLDSDPTVFQWLDQQPPSSVLYVSFGSQSEVDESDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADRSLAKGGSSYESLESLVSYISSL

SEQ ID NO: 653 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcaaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 654 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 655 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaccgagcaactatccgcacttcacctttcgttttatcttggacaacgatccgcaggacgagcggattagcaacctgccgacccatggtccgggcgcgggtatgcgtatcccgatcattaacgagcacggcgcggatgaactgcgtcgtgagctggaaagcctgatgcgggccagcccggaagacgaggaagttagctgcctgattaccgatgcgctgtggtacttcgcgcaaccggtggcggacagcctgaatctgccgcgtctggttctgatgaccagcagcctgtttaacttccacgcgctggtgtcgctgccgatgtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgtgagcctggctaagggtggcagcagctacgagagcctggaaagcctggttagctatattagcagcctg

SEQ ID NO: 656 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKPSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPMFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLAKGGSSYESLESLVSYISSL

SEQ ID NO: 657 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgatgtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgacagcgagcagcagcagcctgctggaccacgatccgaccgtgttccagtggctggaccagcaaccgccgagcagcgtgctgtacgttagctttggcagccagagcgaggtggacgaaagcgaattcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 658 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPMFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDESEFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 659 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgacagcgagcagcagcagcctgctggaccacgatccgaccgtgttccagtggctggaccagcaaccgccgagcagcgtgctgtacgttagctttggcagccagagcgaggtggacgaaagcgaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtggcttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatgcgtcaaaacgcggcggttctgaaggataaagcggatgttagcctgatgaagggtggcagcagctacgagagcctggaaagcctggttagctatattagcagcctg

SEQ ID NO: 660 - protein, 457 aa, Artificial Sequence
  ADP-Glycosyltransferase Variant of SEQ ID NO: 548
MENKTETTVRRRRIILFPVPFPGHINPMLQLANVLYSKGFSITVFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDESEFLEIARGLVDSKQSFLWRVRPGFVKGSEWVEPLPDGFLGERGRIVKSVPQQEVLAHDAIGGFWTHGGWNGTLESVCEGVPMIFSDFGLDQPLNARYMSDVLKVGVYLENGWERGEIANAIRRVMVDREGEVMRQNAAVLKDKADVSLMKGGSSYESLESLVSYISSL

SEQ ID NO: 661 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgtcgctgccgcaatttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccatgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgccttctggacccacggcggttggaacggcaccctggagagcgtttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatcgaagcctggctaagggtggcagcagctacgagagcctggaaagcctggttagctatattagcagcctg

SEQ ID NO: 662 - protein, 457 aa, Artificial Sequence
  ADP-Glycosyltransferase Variant of SEQ ID NO: 548
MENKTETTVRRRRIILFPVPFPGHINPMLQLANVLYSKGFSITVFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADRSLAKGGSSYESLESLVSYISSL

SEQ ID NO: 663 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatccttaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgccttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 664 - protein, 457 aa, Artificial Sequence
  ADP-Glycosyltransferase Variant of SEQ ID NO: 548
MENKTETTVRRRRVILFPVPFPGHINPMLQLANVLYSKGFSITVFHTNFNKPKTSNYPHFTFRFILDNDPQDERISNLPTHGPGAGMRIPILNEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 665 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatacgtgaaattccggcgccgagcttcctgattccgctgccgaagcacctgacagcgagcagcagcagcctgctggaccatgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtggcttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgattcgtcaaaacgcggcggttctgaaggataaagcggatgttagcctgatgaagggtggcagcagctacgagagcctggaaagcctggttagctatattagcagcctg

SEQ ID NO: 666 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGGFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 667 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcgccggaatttcgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttgacgagcttggctacctggatccggacgataaaacccgtctggaggaacaagcggtaggtttcccgatgctgaaagttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 668 - protein, 457 aa, Artificial Sequence
  ADP-Glycosyltransferase Variant of SEQ ID NO: 548
MENKTETTVRRRRIILFPVPFPGHINPMLQLANVLYSKGFSITVFHTNFNKPKTSNYPHFTFRFILDNDPQDERISNLPTHGPGAGMRIPIINEHGAPEFRKELESLMRASPEDEEVACLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 669 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccgtttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcccgttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 670 - protein, 457 aa, Artificial Sequence
  ADP-Glycosyltransferase Variant of SEQ ID NO: 548
MENKTETTVRRRRVILFPVPFPGHINPMLQLANVLYSKGFSITVFHTNFNKPKTSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGWERGEIANAIRRVMVDREGEVIRQNAAVLKDKADVSLMKGGSSYESLESLVSYISSL

SEQ ID NO: 671 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcaagggttttagcatcaccatttttcacaccaacttcaacaagccgaaaccgagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 672 - protein, 457 aa, Artificial Sequence
  ADP-Glycosyltransferase Variant of SEQ ID NO: 548
MENKTETTVRRRRVILFPVPFPGHINPMLQLANVLYSKGFSITIFHTNFNKPKPSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 673 - DNA, 1371 bp, Artificial Sequence
  ADP-Glycosyltransferase Variant of SEQ ID NO: 548
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaacgagcaactatccgcacttcacctttcgttttatcttggacaacgatccgcaggacgagtggattagcaacctgccgacccatggtccgggcgcgggtatgcgtatcccgatcattaacgagcacggcgcggatgaattacgtaaagagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtggcgctgccgatgtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctggcagcgagcagcagcagcctgctggaccatgatccgaccgtgttccagtggctggaccagcaaccgccgagcagcgtgctgtacgttagctttggcagccagagcgaggtggacgaaagcgatttcctggagattgcgcgtggtctggttgatagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgccttctggacccacggcggttggaacggcaccctggagagcgtttgcgaaggcgttccgatgatctttagcgatttcggtctggatcagccgctgaacgcgcgttacatgagcgatgttctgaaagtgggcgtttatctggagaacggctgggagcgtggtgaaatcgcgaacgcgattcgtcgtctgatggttgaccgtgaaggtgaggtgatgcgtgaaaacgcggcggttctgaaggataaagcggatcgaagcctggctaagggtggcagcagctacgagagcctggaaagcctggttagctatattagcagcctg

SEQ ID NO: 674 - protein, 457 aa, Artificial Sequence
  ADP-Glycosyltransferase Variant of SEQ ID NO: 548
MENKTETTVRRRRVILFPVPFPGHINPMLQLANVLYSRGFSITIFHTNFNKPKTSNYPHFTFRFILDNDPQDEWISNLPTHGPGAGMRIPIINEHGADELRKELESLMRASPEDEEVSCLITDALWYFAQPVADSLNLPRLVLMTSSLFNFHALVALPMFDELGYLDPDDKTRLEEQAVGFPMLKVKDIKSAYSNWQIAKEILDKMIKQTRASSGVIWNSFKELEESELETVWREIPAPSFLIPLPKHLAASSSSLLDHDPTVFQWLDQQPPSSVLYVSFGSQSEVDESDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRLMVDREGEVMRENAAVLKDKADRSLAKGGSSYESLESLVSYISSL

SEQ ID NO: 675 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcccgttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgggagcctgatgaagggtggcagcagctacgagagcctggaaagcctggttagctatattagcagcctg

SEQ ID NO: 676 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDEWISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSPFGLDQPLNARYMSDVLKVGVYLENGWERGEIANAIRRVMVDREGEVIRQNAAVLKDKADGSLMKGGSSYESLESLVSYISSL

SEQ ID NO: 677 - DNA, 1371 bp, Artificial Sequence
  ADP-Glycosyltransferase Variant of SEQ ID NO: 548
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaagggtggcagcagctacgagagcctggaaagcctggttagctatattagcagcctg

SEQ ID NO: 678 - protein, 457 aa, Artificial Sequence
  ADP-Glycosyltransferase Variant of SEQ ID NO: 548
MENKTETTVRRRRIILFPVPFPGHINPILQLANVLYSKGFSITIFHTNFNKPKTSNYPHFTFRFILDNDPQDERISNLPTHGPGAGMRIPIINEHGADELRRELESLMRASPEDEEVACLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLTASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMKGGSSYESLESLVSYISSL

SEQ ID NO: 679 - DNA, 1371 bp, Artificial Sequence
  ADP-Glycosyltransferase Variant of SEQ ID NO: 548
atggagaacaaaaccgaaaccaccgtgcgtcgtcgtcgtattattctgtttccggttccgttcccgggccacatcaacccgatgctgcaactggcgaacgtgctgtacagcaagggttttagcatcaccatttttcacaccaacttcaacaagccgaaaccgagcaactatccgcacttcacctttcgttttatcttggacaacgatccgcaggacgagcgtattagcaacctgccgacccatggtccgggcgcgggtatgcgtatcccgatcattaacgagcacggcgcggatgaactgcgtcgtgagctggaaagcctgatgcgggcgagcccggaagacgaggaagttagctgcctgattaccgatgcgctgtggtacttcgcgcaaccggtggcggacagcctgaacctgccgcgtctggttctgatgaccagcagcctgtttaacttccacgcgctggtgagcctgccgcagtttgacgagcttggctacctggatccggacgataaaacccgtctggaggaacaagcggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgttatccgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgaccgtgaaggtgaggtgatccgtcagaacgcggcggttctgaaggataaagcggatgttagcctgatgaatggtggcagcagctacgagagcctggaaagcctggttagctatattagcagcctg

SEQ ID NO: 680 - protein, 457 aa, Artificial Sequence
  ADP-Glycosyltransferase Variant of SEQ ID NO: 548
MENKTETTVRRRRIILFPVPFPGHINPMLQLANVLYSKGFSITIFHTNFNKPKPSNYPHFTFRFILDNDPQDERISNLPTHGPGAGMRIPIINEHGADELRRELESLMRASPEDEEVSCLITDALWYFAQPVADSLNLPRLVLMTSSLFNFHALVSLPQFDELGYLDPDDKTRLEEQAVGFPMLKVKDIKSAYSNWQIAKEILDKMIKQTRASSGVIWNSFKELEESELETVIREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIANAIRRVMVDREGEVIRQNAAVLKDKADVSLMNGGSSYESLESLVSYISSL

SEQ ID NO: 681 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttagcaacctgccgacccatggtccgggcgcgggttggcgtatcccgatcattaacgagcacggcgcggatgaattccgtaaagagctggaaagcctgatgcggggcagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccgagcgataaaacccgtctggaggaacaagtggtaggtttcccgatgctgaaggttaaagatatcaagcgcgcgtatagcaattggcagattaaaaaagaaattctggataagatgattgccggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaatcagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 682 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLSNLPTHGPGAGWRIPIINEHGADEFRKELESLMRGSPEDEEVACLITDALWYFAQPVADSLGLPRLVLMTSSLFNFHALVSLPQFLELGYLDPSDKTRLEEQVVGFPMLKVKDIKRAYSNWQIKKEILDKMIAGTRASSGVIWNSFKELEESELETVWREIPAPSFLIPLPKHLRASSSSLLDHDPTVFQWLDQQPPSSVLYVSFGSQSEVDESDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADQSLAKGGSSYESLESLVSYISSL

SEQ ID NO: 683 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgagcgataaaacccgtctggaggaacaagtggtaggtttcccgatgctgaaggttaaagatatcaagcgcgcgtatagcaattggcagattaaaaaagaaattctggataagatgcttaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtctgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 684 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGWRIPIINEHGADEFRKELESLMRASPEDEEVACLITDALWYFAQPVADSLNLPRLVLMTSSLFNFHALVSLPQFLELGYLDPSDKTRLEEQVVGFPMLKVKDIKRAYSNWQIKKEILDKMLKGTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRLMVDREGEVMRQNAAVLKDKADVSLAKGGSSYESLESLVSYISSL

SEQ ID NO: 685 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccgtttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgatgtttttagagcttggctacctggatccgagcgataaaacccgtctggaggaacaagtggtaggtttcccgatgctgaaggttaaagatatcaagcgcgcgtatagcaattggcagattaaaaaagaaattctggataagatgattgaccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 686 - protein, 457 aa, Artificial Sequence
  ADP-Glycosyltransferase Variant of SEQ ID NO: 562
MENKTETTVRRRRVILFPVPFPGHINPMLQLANVLYSRGFSITVFHTNFNKPKTSNYPHFTFRFILDNDPQDEWISNLPTHGPGAGWRIPIINEHGADEFRKELESLMRASPEDEEVACLITDALWYFAQPVADSLGLPRLVLMTSSLFNFHALVSLPMFLELGYLDPSDKTRLEEQVVGFPMLKVKDIKRAYSNWQIKKEILDKMIDQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 687 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccgtttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagattaaaaaagaaattctggataagatgattgcccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 688 - protein, 457 aa, Artificial Sequence
  ADP-Glycosyltransferase Variant of SEQ ID NO: 562
MENKTETTVRRRRVILFPVPFPGHINPMLQLANVLYSRGFSITVFHTNFNKPKTSNYPHFTFRFILDNDPQDEWISNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIKKEILDKMIAQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 689 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatccttaacgagcacggcgcggatgaattccgtaaagagctggaaagcctgatgcgggccagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccgggtgataaaacccgtctggaggaacaagtggtaggtttcccgatgctgaaggttaaagatatcaagcgcgcgtatagcaattggcagattaaaaaagaaattctggataagatgattgccggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaatcagaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 690 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGWRIPILNEHGADEFRKELESLMRASPEDEEVACLITDALWYFAQPVADSLNLPRLVLMTSSLFNFHALVSLPMFLELGYLDPGDKTRLEEQVVGFPMLKVKDIKRAYSNWQIKKEILDKMIAGTRASSGVIWNSFKELEESELETVWREIPAPSFLIPLPKHLRASSSSLLDHDPTVFQWLDQQPPSSVLYVSFGSQSEVDESEFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 691 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatgaaaaaagaaattctggataagatgcttgaccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtttgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgtggcggttctgaaggataaagcggatcggagcctggctaagggtggcagcagctacgagagcctggaaagcctggttagctatattagcagcctg

SEQ ID NO: 692 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLGLPRLVLMTSSLFNFHALVSLPQFLELGYLDPGDKTRLEEQVVGFPMLKVKDIKSAYSNWQMKKEILDKMLDQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNVAVLKDKADRSLAKGGSSYESLESLVSYISSL

SEQ ID NO: 693 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcggattaaaaaagaaattctggataagatgattaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 694 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWRIKKEILDKMIKGTRASSGVIWNSFKELEESELETVWREIPAPSFLIPLPKHLRASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 695 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 696 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 697 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccgctgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagattaaaaaagaaattctggataagatgcttgcccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 698 - protein, 457 aa, Artificial Sequence
  ADP-Glycosyltransferase Variant of SEQ ID NO: 562
MENKTETTVRRRRVILFPLPFPGHINPMLQLANVLYSRGFSITIFHTNFNKPKTSNYPHFTFRFILDNDPQDEWLRNLPTHGPGAGWRIPILNEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIKKEILDKMLAQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 699 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggccagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagattaaaaaagaaattctggataagatgattgccggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaaaaagaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatcggagcctggctaagggtggcagcagctacgagagcctggaaagcctggttagctatattagcagcctg

SEQ ID NO: 700 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLGLPRLVLMTSSLFNFHALVSLPQFLELGYLDPGDKTRLEEQVVGFPMLKVKDIKSAYSNWQIKKEILDKMIAGTRASSGVIWNSFKELEESELETVWREIPAPSFLIPLPKHLRASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADRSLAKGGSSYESLESLVSYISSL

SEQ ID NO: 701 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcagtttttagagcttggctacctggatccgagcgataaaacccgtctggaggaacaagtggtaggtttcccgatgctgaaggttaaagatatcaagagcgcgtatagcaattggcggattaaaaaagaaattctggataagatgcttaaaggaacccgtgcgagcagcggtgtgatttggaacagctttagagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtctgatggttgaccgtgaaggtgaggtgatgcgtcaaaacgcggcggttctgaaggataaagcggatcggagcctggctaagggtggcagcagctacgagagcctggaaagcctggttagctatattagcagcctg

SEQ ID NO: 702 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLNLPRLVLMTSSLFNFHALVSLPQFLELGYLDPSDKTRLEEQVVGFPMLKVKDIKSAYSNWRIKKEILDKMLKGTRASSGVIWNSFRELEESELETVWREIPAPSFLIPLPKHLRASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRLMVDREGEVMRQNAAVLKDKADRSLAKGGSSYESLESLVSYISSL

SEQ ID NO: 703 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgagcgataaaacccgtctggaggaacaagtggtaggtttcccgatgctgaaggttaaagatatcaagcgcgcgtatagcaattggcggattaaaaaagaaattctggataagatgcttgaccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 704 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLNLPRLVLMTSSLFNFHALVSLPQFLELGYLDPSDKTRLEEQVVGFPMLKVKDIKRAYSNWRIKKEILDKMLDQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 705 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttagcaacctgccgacccatggtccgggcgcgggtatgcgtatcccgatcattaacgagcacggcgcggatgaattccgtaaagagctggaaagcctgatgcggggcagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcggattaaaaaagaaattctggataagatgattgcccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagaattcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtctgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 706 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLSNLPTHGPGAGMRIPIINEHGADEFRKELESLMRGSPEDEEVACLITDALWYFAQPVADSLNLPRLVLMTSSLFNFHALVSLPQFLELGYLDPGDKTRLEEQVVGFPMLKVKDIKSAYSNWRIKKEILDKMIAQTRASSGVIWNSFKELEESELETVWREIPAPSFLIPLPKHLRASSSSLLDHDPTVFQWLDQQPPSSVLYVSFGSQSEVDEKEFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRLMVDREGEVMRQNAAVLKDKADVSLAKGGSSYESLESLVSYISSL

SEQ ID NO: 707 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccgggcgataaaacccgtctggaggaacaagtggtaggtttcccgatgctgaaggttaaagatatcaagcgcgcgtatagcaattggcagattaaaaaagaaattctggataagatgattaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 708 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPILNEHGADEFRKELESLMRASPEDEEVACLITDALWYFAQPVADSLGLPRLVLMTSSLFNFHALVSLPQFLELGYLDPGDKTRLEEQVVGFPMLKVKDIKRAYSNWQIKKEILDKMIKGTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 709 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatccttaacgagcacggcgcggatgaattccgtaaagagctggaaagcctgatgcggggcagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgagcgataaaacccgtctggaggaacaagtggtaggtttcccgatgctgaaggttaaagatatcaagagcgcgtatagcaattggcagattaaaaaagaaattctggataagatgcttaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggaattcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 710 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGWRIPILNEHGADEFRKELESLMRGSPEDEEVACLITDALWYFAQPVADSLNLPRLVLMTSSLFNFHALVSLPQFLELGYLDPSDKTRLEEQVVGFPMLKVKDIKSAYSNWQIKKEILDKMLKGTRASSGVIWNSFKELEESELETVWREIPAPSFLIPLPKHLRASSSSLLDHDPTVFQWLDQQPPSSVLYVSFGSQSEVDEKEFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 711 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattcgcaacctgccgacccatggtccgggcgcgggtatgcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagattaaaaaagaaattctggataagatgattaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgccttctggacccacggcggttggaacggcaccctggagagcgtttgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 712 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWIRNLPTHGPGAGMRIPILNEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIKKEILDKMIKGTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 713 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatcggagcctggctaagggtggcagcagctacgagagcctggaaagcctggttagctatattagcagcctg

SEQ ID NO: 714 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGWRIPIINEHGADEFRKELESLMRASPEDEEVACLITDALWYFAQPVADSLGLPRLVLMTSSLFNFHALVSLPQFLELGYLDPGDKTRLEEQVVGFPMLKVKDIKSAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADRSLAKGGSSYESLESLVSYISSL

SEQ ID NO: 715 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccgtttttcacaccaacttcaacaagccgaaaaccagcaactatccgcacttcacctttcgttttatcttggacaacgatccgcaggacgagtggattcgcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcggattaaaaaagaaattctggataagatgattgaccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtggcttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 716 - protein, 457 aa, Artificial Sequence
  ADP-Glycosyltransferase Variant of SEQ ID NO: 562
MENKTETTVRRRRVILFPVPFPGHINPMLQLANVLYSRGFSITVFHTNFNKPKTSNYPHFTFRFILDNDPQDEWIRNLPTHGPGAGMRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWRIKKEILDKMIDQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGGFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 717 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttagcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 718 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLSNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 719 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccgctgccgttcccgggccacatcaacccgatgctgcaactggcgaacgtgctgtacagcagaggttttagcatcaccgtttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcggggcagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatgaaaaaagaaattctggataagatgattgcccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgccttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 720 - protein, 457 aa, Artificial Sequence
  ADP-Glycosyltransferase Variant of SEQ ID NO: 562
MENKTETTVRRRRVILFPLPFPGHINPMLQLANVLYSRGFSITVFHTNFNKPKTSNYPHFTFRFILDNDPQDEWISNLPTHGPGAGMRIPIINEHGADEFRKELESLMRGSPEDEEVACLITDALWYFAQPVADSLNLPRLVLMTSSLFNFHALVSLPQFLELGYLDPGDKTRLEEQVVGFPMLKVKDIKRAYSNWQMKKEILDKMIAQTRASSGVIWNSFKELEESELETVWREIPAPSFLIPLPKHLRASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 721 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccgtttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatccttaacgagcacggcgcggatgaattccgtaaagagctggaaagcctgatgcgggccagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgatgtttttagagcttggctacctggatccgggcgataaaacccgtctggaggaacaagtggtaggtttcccgatgctgaaggttaaagatatcaagagcgcgtatagcaattggcagattaaaaaagaaattctggataagatgattaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 722 - protein, 457 aa, Artificial Sequence
  ADP-Glycosyltransferase Variant of SEQ ID NO: 562
MENKTETTVRRRRVILFPVPFPGHINPMLQLANVLYSRGFSITVFHTNFNKPKTSNYPHFTFRFILDNDPQDEWISNLPTHGPGAGWRIPILNEHGADEFRKELESLMRASPEDEEVACLITDALWYFAQPVADSLGLPRLVLMTSSLFNFHALVSLPMFLELGYLDPGDKTRLEEQVVGFPMLKVKDIKSAYSNWQIKKEILDKMIKGTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 723 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagaattcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 724 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLRNLPTHGPGAGWRIPILNEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKEFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 725 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatcattaacgagcacggcgcggatgaattccgtaaagagctggaaagcctgatgcgggccagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggcgataaaacccgtctggaggaacaagtggtaggtttcccgatgctgaaggttaaagatatcaagcgcgcgtatagcaattggcagatgaaaaaagaaattctggataagatgattaagcagacccgtgcgagcagcggtgtgatttggaacagctttagagagctggaggaaagcgagctggaaaccgtttggcgtgaaattccggcgccgagcttcctgattctgctgccgaagcacctgagggcgagcagcagcagcctgctggaccatgatccgaccgtgttccagtggctggaccagcaaccgccgagcagcgtgctgtacgttagctttggcagccagagcgaggtggacgaatcagatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatcggagcctggctaagggtggcagcagctacgagagcctggaaagcctggttagctatattagcagcctg

SEQ ID NO: 726 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQMKKEILDKMIKQTRASSGVIWNSFRELEESELETVWREIPAPSFLILLPKHLRASSSSLLDHDPTVFQWLDQQPPSSVLYVSFGSQSEVDESDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADRSLAKGGSSYESLESLVSYISSL

SEQ ID NO: 727 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatccttaacgagcacggcgcggatgaattccgtaaagagctggaaagcctgatgcgggccagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatcgcgaaagaaattctggataagatgattgcccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 728 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGWRIPILNEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIAKEILDKMIAQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 729 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcggatgaaaaaagaaattctggataagatgattgacggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 730 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWRMKKEILDKMIDGTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 731 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccgagcgataaaacccgtctggaggaacaagtggtaggtttcccgatgctgaaggttaaagatatcaagcgcgcgtatagcaattggcagatggcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaatgcgcgttacatgagcgatgttctgaaagtgggcgtttatctggagaacggctgggagcgtggtgaaatcgaaaacgcgattcgtcgtctgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 732 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGWRIPILNEHGADEFRKELESLMRASPEDEEVACLITDALWYFAQPVADSLNLPRLVLMTSSLFNFHALVSLPMFLELGYLDPSDKTRLEEQVVGFPMLKVKDIKRAYSNWQMAKEILDKMIKQTRASSGVIWNSFKELEESELETVWREIPAPSFLIPLPKHLRASSSSLLDHDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRLMVDREGEVMRQNAAVLKDKADQSLAKGGSSYESLESLVSYISSL

SEQ ID NO: 733 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatcgcgaaagaaattctggataagatgcttgcccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaatcagaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtctgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 734 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMLAQTRASSGVIWNSFKELEESELETVWREIPAPSFLIPLPKHLRASSSSLLDHDPTVFQWLDQQPPSSVLYVSFGSQSEVDESEFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRLMVDREGEVMRQNAAVLKDKADQSLAKGGSSYESLESLVSYISSL

SEQ ID NO: 735 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 736 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLGLPRLVLMTSSLFNFHALVSLPQFLELGYLDPGDKTRLEEQVVGFPMLKVKDIKSAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 737 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccgctgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattaaaaaagaaattctggataagatgattaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaaaaagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtctgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 738 - protein, 457 aa, Artificial Sequence
  ADP-Glycosyltransferase Variant of SEQ ID NO: 562
MENKTETTVRRRRVILFPLPFPGHINPMLQLANVLYSRGFSITIFHTNFNKPKTSNYPHFTFRFILDNDPQDEWISNLPTHGPGAGWRIPILNEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIKKEILDKMIKGTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRLMVDREGEVMRQNAAVLKDKADQSLAKGGSSYESLESLVSYISSL

SEQ ID NO: 739 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 740 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLRNLPTHGPGAGWRIPILNEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 741 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttagcaacctgccgacccatggtccgggcgcgggttggcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgagcgataaaacccgtctggaggaacaagtggtaggtttcccgatgctgaaggttaaagatatcaagagcgcgtatagcaattggcagattgcgaaagaaattctggataagatgcttgcccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtctgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 742 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLSNLPTHGPGAGWRIPILNEHGADEFRKELESLMRASPEDEEVACLITDALWYFAQPVADSLNLPRLVLMTSSLFNFHALVSLPQFLELGYLDPSDKTRLEEQVVGFPMLKVKDIKSAYSNWQIAKEILDKMLAQTRASSGVIWNSFKELEESELETVWREIPAPSFLIPLPKHLRASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRLMVDREGEVMRQNAAVLKDKADQSLAKGGSSYESLESLVSYISSL

SEQ ID NO: 743 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccgtttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatcattaacgagcacggcgcggatgaattccgtaaagagctggaaagcctgatgcgggccagcccggaagacgaggaagttgcgtgcctgattaccgatgcgctgtggtacttcgcgcaaccggtggcggacagcctgggactgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcggattgcgaaagaaattctggataagatgattaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaatcagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 744 - protein, 457 aa, Artificial Sequence
  ADP-Glycosyltransferase Variant of SEQ ID NO: 562
MENKTETTVRRRRVILFPVPFPGHINPMLQLANVLYSRGFSITVFHTNFNKPKTSNYPHFTFRFILDNDPQDEWISNLPTHGPGAGWRIPIINEHGADEFRKELESLMRASPEDEEVACLITDALWYFAQPVADSLGLPRLVLMTSSLFNFHALVSLPQFLELGYLDPGDKTRLEEQVVGFPMLKVKDIKRAYSNWRIAKEILDKMIKGTRASSGVIWNSFKELEESELETVWREIPAPSFLIPLPKHLRASSSSLLDHDPTVFQWLDQQPPSSVLYVSFGSQSEVDESDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 745 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcagtttttagagcttggctacctggatccgggcgataaaacccgtctggaggaacaagtggtaggtttcccgatgctgaaggttaaagatatcaagagcgcgtatagcaattggcggattaaaaaagaaattctggataagatgcttgaccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 746 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPILNEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWRIKKEILDKMLDQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 747 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttagcaacctgccgacccatggtccgggcgcgggttggcgtatcccgatcattaacgagcacggcgcggatgaattccgtaaagagctggaaagcctgatgcggggcagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcggatggcgaaagaaattctggataagatgcttgaccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccatgatccgaccgtgttccagtggctggaccagcaaccgccgagcagcgtgctgtacgttagctttggcagccagagcgaggtggacgaatcagaattcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtctgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 748 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWLSNLPTHGPGAGWRIPIINEHGADEFRKELESLMRGSPEDEEVACLITDALWYFAQPVADSLNLPRLVLMTSSLFNFHALVSLPQFLELGYLDPGDKTRLEEQVVGFPMLKVKDIKRAYSNWRMAKEILDKMLDQTRASSGVIWNSFKELEESELETVWREIPAPSFLIPLPKHLRASSSSLLDHDPTVFQWLDQQPPSSVLYVSFGSQSEVDESEFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRLMVDREGEVMRQNAAVLKDKADVSLAKGGSSYESLESLVSYISSL

SEQ ID NO: 749 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgatgtttttagagcttggctacctggatccgggtgataaaacccgtctggaggaacaagtggtaggtttcccgatgctgaaggttaaagatatcaagagcgcgtatagcaattggcggattaaaaaagaaattctggataagatgcttaaaggaacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 750 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLNLPRLVLMTSSLFNFHALVSLPMFLELGYLDPGDKTRLEEQVVGFPMLKVKDIKSAYSNWRIKKEILDKMLKGTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 751 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtctgcgtatcccgatccttaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcggatgaaaaaagaaattctggataagatgattgaccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttcaaagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 752 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGLRIPILNEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWRMKKEILDKMIDQTRASSGVIWNSFKELEESELETVWREIPAPSFLIPLPKHLRASSSSLLDHDPTVFQWLDQQPPSSVLYVSFGSQSEVDEKDFLEIARGLVQSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 753 - DNA, 1371 bp, Artificial Sequence
  ADP-Glycosyltransferase Variant of SEQ ID NO: 562
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagagcgcgtatagcaattggcagatcgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaagatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatcggagcctggctaagggtggcagcagctacgagagcctggaaagcctggttagctatattagcagcctg

SEQ ID NO: 754 - protein, 457 aa, Artificial Sequence
  ADP-Glycosyltransferase Variant of SEQ ID NO: 562
MENKTETTVRRRRVILFPVPFPGHINPMLQLANVLYSRGFSITIFHTNFNKPKTSNYPHFTFRFILDNDPQDEWISNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKSAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADRSLAKGGSSYESLESLVSYISSL

SEQ ID NO: 755 - DNA, 1422 bp, Artificial Sequence
  codon-optimized Oryza Sativa Japonica glycosyltransferase
atgcaccatcatcatcatcatggcggtagcggcatggatagcggctatagcagctcctacgccgcagcagcaggtatgcacgtcgtcatttgcccgtggcttgcgtttggccatttacttccgtgcctggacctcgctcagcgtttagcaagccgtggtcatcgcgtgagctttgtgagcactccacgcaatattagccgtttaccaccagttcgtccagcacttgcaccactggttgcattcgttgcactgccactgccacgtgttgaaggtctgccagatggtgcagaaagcaccaacgatgtgccacatgatcgtccagacatggttgaattacatcgtcgcgcctttgatggtctggccgcaccattcagtgagttcctgggtactgcatgtgcagattgggttatcgttgacgtgtttcatcattgggcagcagcagcagcgctcgaacacaaggtgccatgcgcgatgatgctgctgggcagcgcgcacatgatcgcgtcaatcgcagatcgtcgtctggaacgtgcggaaactgaaagtccagcagcagcaggtcaaggtcgtccagcagcagcaccaacttttgaagtcgcgcgcatgaaactgatccgcactaaaggtagtagtggcatgtctttagcggaacgttttagcctgaccctgagccgtagcagtttagtggttggtcgtagttgcgtcgagttcgaaccagaaacggttccgctgttatcaactctgcgcggtaaacctattacctttcttggcttaatgccgcccttacatgaaggtcgtcgtgaagatggtgaagacgcaactgttcgttggcttgacgcacagccagcaaaaagcgttgtctatgtcgcactgggtagtgaagtgccgttaggtgtggaaaaagtccatgaactggctctgggcctggagttagctgggactcgtttcctgtgggcactgcgcaaaccaactggtgttagcgatgcagatctgctgccagcgggttttgaagaacgcacccgtggtcgtggtgttgtcgcaactcgttgggtgccgcagatgtcgattcttgcacatgcagcagttggtgcgttcctgacccattgcggttggaacagcaccattgaaggcctgatgttcggtcatccactgatcatgctgccgatcttcggtgatcaaggcccgaatgcgcgtctgatcgaggcgaaaaacgcgggtttacaggttgcgcgcaatgatggtgatggcagtttcgatcgcgaaggtgttgcggcggctatccgcgcggttgcagtggaagaagaaagcagcaaggtgtttcaggcaaaggcgaaaaagctgcaagagatcgttgcggatatggcatgtcacgaacgctacattgatggtttcatccagcagctgcgtagttacaaagactaa

SEQ ID NO: 756 - protein, 473 aa, Artificial Sequence
  codon-optimized Oryza Sativa Japonica glycosyltransferase
MHHHHHHGGSGMDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 757 - DNA, 1356 bp, Artificial Sequence
  codon-optimized Solanum tuberosum glycosyltransferase
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcattatcaagaagatcccggagaaatacagtgagagcatccgttttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgcctaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgttgacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcctggattttggcgttccgatcattgcgatgccgatgcacaacgatcagccgattaacgcgaagctgatcgtggaattaggcgttgcaatggagatcgtgcgtgatgacgatggcaacattcaccgcggcgaaattacggaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 758 - protein, 451 aa, Artificial Sequence
  codon-optimized Solanum tuberosum glycosyltransferase
MHHHHHHGGSGATLRVLMFPWLAYGHISPFLNIAKQLADRGFLIYLCSTLINLESIIKKIPEKYSESIRFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIYLPKVEQVKMREMFEKEPNEEDRLAEGNMQIMLMCTSRTIEAKYLDYCTELSNWKVVPVGPPFQDPITNDVDDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAMEIVRDDDGNIHRGEITETLKDVITGETGEILRGKVRDISKNLKSIREEEMNAAAEELIQLCRNSNKYK

SEQ ID NO: 759 - DNA, 1344 bp, Artificial Sequence
  codon-optimized Solanum tuberosum glycosyltransferase
atgcaccatcatcatcatcatggcggtagcggcatggcaaccttgcgcgttctgatgtttccgtggctcgcgtatggacatatctctcctttcctgaatgtagcaaaaaaactggccgaccgtgggttcctgatttatttgtgtagtactccgattaatttgaagagcaccatcaagaagatcccggagaaatatgcagatagcatccagctgatcgagttacacctgccagaactgccggaattaccaccacattatcataccaccaacggttttccgccacatctgaacaacaccctgcataaagccctggagatgagcaagccgaactttagcaagatcctgcaaaacctgaagccggacctggttatttacgatatgctgcaacagtgggcagaacatgtcgcgaatgaacagaacatcccagcggtgaaactgattaccttcggtgcagcagtctttagctacctgttctacctggttaagaagccggaagcagtgtttccgtttcccgcgattaacctgtcgaagatcgaacaggaaaagatgtacgcgaaagacttcgaagaccgcttggttgacggcaacatccagatcatgctcattagcaccagtcgtaccattgaagcgaagtacattgatcactgtaccgagctgattaattggaaggtggtgccggttggtccgccagtgcaggacccaatcacgaacaacgcggatgataaggagctgatggattggcttggtactaaagacgagaacagcaccgtgtttgtgagctttggcagcgaatatttcctgagcaaggaagatatggaagaagttgcatttggcctggaactcagtaatgtgaacttcatctgggtggcacgctttccgaaaggcgaagatcaaaatctggaagatgcgttaccgaaaggcttcctggaacgtattggtgaacgtggtcgcgtactggataagtttgcgccgcagccacgcattctgaaccatccgagcaccggcggtttcatctcgcattgcggttggaacagcgtaatggagagcgtggatttcggtgttccgatcatcgcaatgccgatccagtacgatcagccgtcaaatgcacgtctgatcgtggagctgggtgttgcggttgagattgttcgcgacgatgatggcaagattcaccgtggtgaaatcgcggaaaccctgaaggatgtgattaccggcaaaaccggcgaaaatctgcgcggtaaagtacgcgacattagcaagaacctgaagtcaatccgcggtgaggagatggacaccgcggcggaagtgcttatccagctgtgtaagaacagcaacgagtgtaagtaa

SEQ ID NO: 760 - protein, 447 aa, Artificial Sequence
  codon-optimized Solanum tuberosum glycosyltransferase
MHHHHHHGGSGMATLRVLMFPWLAYGHISPFLNVAKKLADRGFLIYLCSTPINLKSTIKKIPEKYADSIQLIELHLPELPELPPHYHTTNGFPPHLNNTLHKALEMSKPNFSKILQNLKPDLVIYDMLQQWAEHVANEQNIPAVKLITFGAAVFSYLFYLVKKPEAVFPFPAINLSKIEQEKMYAKDFEDRLVDGNIQIMLISTSRTIEAKYIDHCTELINWKVVPVGPPVQDPITNNADDKELMDWLGTKDENSTVFVSFGSEYFLSKEDMEEVAFGLELSNVNFIWVARFPKGEDQNLEDALPKGFLERIGERGRVLDKFAPQPRILNHPSTGGFISHCGWNSVMESVDFGVPIIAMPIQYDQPSNARLIVELGVAVEIVRDDDGKIHRGEIAETLKDVITGKTGENLRGKVRDISKNLKSIRGEEMDTAAEVLIQLCKNSNECK

SEQ ID NO: 761 - DNA, 1398 bp, Artificial Sequence
  codon-optimized  Lycium barbarum glycosyltransferase
atgcaccatcatcatcatcatggcggtagcggcatgggcaccgaagtcacggttcataaaaacaccctgcgcgttctgatgtttccgtggttagcctatggtcatattagcccgttcctgaatgtcgcgaaaaagctggttgatcgtggcttcctgatctacctgtgcagcacggcgattaacctgaagagcaccatcaagaagatcccggagaaatatagcgatagcattcagctgatcgagttacacctgccagaattaccggaactgccaccacattatcatactaccaacggtttaccaccgcatctgaaccataccctgcaaaaagccctgaagatgagcaagccgaactttagcaagatcctgcaaaacctgaagccggacctggttatttacgatctgctccagcagtgggcggaaggtgtggctaacgaacagaacatcccggctgtgaagttgttaacaagtggtgcagcggttctgagctactttttcaacctggttaaaaaaccgggtgtcgaatttccgtttccggctatctacctgcgcaaaaacgagctggaaaagatgagcgaactgctcgcacaaagcgcaaaagacaaagaaccagacggtgttgatccattcgctgatggcaacatgcaggtcatgctgatgagcacttcgcgcattattgaggcgaagtacattgactactttagcggcctgtcaaattggaaagtggttccagttggtccgccggtgcaagatccaattgcggatgatgcagacgagatggaactgattgattggcttggtaaaaaggatgagaatagcaccgtttttgtgagcttcggtagtgagtacttcctgagcaaggaagaccgcgaagaaattgcattcggtctggaacttagcaacgttaacttcatctgggttgcacgttttccgaaaggtgaagaacaaaatctggaagacgctctgccaaaaggtttcctggaacgtatcggtgatcgtggtcgtgttctggacaagttcgctccgcagccgcgcattctgaaccatccgagcaccggtggttttattagccattgtggttggaatagcgtcatggaaagcgtggatttcggcgttccaatcattgcgatgccgattcatctggatcagccgatgaatgcgcgcctgatcgttgaactgggtgtcgcagtggagattgtgcgcgacgactatggcaagatccatcgcgaagaaattgcggagatcctgaaagatgtgatcgcaggtaagagcggtgagaacctgaaggcgaaaatgcgcgacattagcaagaacctgaagagcatccgcgacgaagaaatggacaccgcggcggaagaactgatccagctgtgtaagaacagcccgaagctgaaataa

SEQ ID NO: 762 - protein, 465 aa, Artificial Sequence
  codon-optimized  Lycium barbarum glycosyltransferase
MHHHHHHGGSGMGTEVTVHKNTLRVLMFPWLAYGHISPFLNVAKKLVDRGFLIYLCSTAINLKSTIKKIPEKYSDSIQLIELHLPELPELPPHYHTTNGLPPHLNHTLQKALKMSKPNFSKILQNLKPDLVIYDLLQQWAEGVANEQNIPAVKLLTSGAAVLSYFFNLVKKPGVEFPFPAIYLRKNELEKMSELLAQSAKDKEPDGVDPFADGNMQVMLMSTSRIIEAKYIDYFSGLSNWKVVPVGPPVQDPIADDADEMELIDWLGKKDENSTVFVSFGSEYFLSKEDREEIAFGLELSNVNFIWVARFPKGEEQNLEDALPKGFLERIGDRGRVLDKFAPQPRILNHPSTGGFISHCGWNSVMESVDFGVPIIAMPIHLDQPMNARLIVELGVAVEIVRDDYGKIHREEIAEILKDVIAGKSGENLKAKMRDISKNLKSIRDEEMDTAAEELIQLCKNSPKLK

SEQ ID NO: 763 - DNA, 1374 bp, Artificial Sequence
  codon-optimized Solanum lycopersicum glycosyltransferase
atgcaccatcatcatcatcatggcggtagcggcatgagcaccaccctgaaagtactgatgtttccgtttcttgcgtatggtcacatttctccatacctgaatgtcgctaaaaaacttgcagaccgtggctttctcatctacctgtgcagcaccccaattaacctgaaaagcaccattaacaagatcccggagaaatacgcagactctattcagctgatcgaactgcacctgccagaattaccggaactgccaccacattaccacaccactaatggtctgccaccaaatctgaaccatattctgcgtcgtgcgttgaagatgagcaaaccgaactttagcaagatcatgcagaatctgaaaccggatctgctgatctacgatattctccagcagtgggcagaagatgtcgcaactgagctgaacattccggcggttaaactgttgaccagtggtgtcgcagtgtttagctactttttcaacctgaccaaaaagcccgaagtggagttcccatacccggcgatctatctgcgcaagatcgaactggtacgttggtgtgaaaccctgagcaagcacaacaaagaaggcgaagaacatgacgatggtctggcctatggcaacatgcagatcatgctgatgagcacgagcaagatcctggaggcgaaatacattgactattgtatcgagctgaccaattggaaagtcgttccggttggtagtttagtgcaggattcgattaccaacgatgcagcagatgacgatatggagttaattgattggcttggtactaaagacgagaatagcaccgtgtttgtgagctttggcagcgagtatttcctgagcaaagaagatgttgaagaagtggcgttcggtctggagctgagcaacgtgaactttatctgggttgttcgctttccgaaaggcgaagaaaaaaatctggaagatgttctgccaaaaggcttctttgaacgtattggcgaacgtggtcgtgttctggataagtttgcgccgcagccacgcattctgaaccatccgagcacgggtggcttcattagccattgcggttggaacagcgcgatggagagcattgattttggcgtccctatcgtggcaatgccgatgcagctggaccagccaatgaatgcgcgcctgattgtggagctgggtgttgcggtggagattgtccgtgacgatgatggcaagatttaccgcggagaaattgcggagaccctgaaaggtgtgatcacgggagagattggtgagatcctgcgtgcaaaggtgcgtgacattagcaagaacctgaaggctatcaaagacgaggagatggatgtggcggcgcaggagctgatccagctgtgtcgcaacagcaacaagtaa

SEQ ID NO: 764 - protein, 457 aa, Artificial Sequence
  codon-optimized Solanum lycopersicum glycosyltransferase
MHHHHHHGGSGMSTTLKVLMFPFLAYGHISPYLNVAKKLADRGFLIYLCSTPINLKSTINKIPEKYADSIQLIELHLPELPELPPHYHTTNGLPPNLNHILRRALKMSKPNFSKIMQNLKPDLLIYDILQQWAEDVATELNIPAVKLLTSGVAVFSYFFNLTKKPEVEFPYPAIYLRKIELVRWCETLSKHNKEGEEHDDGLAYGNMQIMLMSTSKILEAKYIDYCIELTNWKVVPVGSLVQDSITNDAADDDMELIDWLGTKDENSTVFVSFGSEYFLSKEDVEEVAFGLELSNVNFIWVVRFPKGEEKNLEDVLPKGFFERIGERGRVLDKFAPQPRILNHPSTGGFISHCGWNSAMESIDFGVPIVAMPMQLDQPMNARLIVELGVAVEIVRDDDGKIYRGEIAETLKGVITGEIGEILRAKVRDISKNLKAIKDEEMDVAAQELIQLCRNSNK

SEQ ID NO: 765 - DNA, 1395 bp, Artificial Sequence
  codon-optimized Solanum lycopersicum glycosyltransferase
atgcaccatcatcatcatcatggcggtagcggcatggggactcaggtgacggaacatggtacttctaatcttcgcgttgtaatgtttccgtggttagcctatggtcatatttccccattcctgtacgtcgcgaaaaaactggctgatcgtggtttcctgatttacctgtgcagcaccccgattaacctgaagagcaccatcgaaaagattccggagaaatatgcagactctatccacctgatcgagctgcatctgccagaactgccggaattaccaccgcattaccatactaccaacggtttaccaccccatctgaaccataccctgcaaaaggcactgaagatgagcaagccgaacctgagcaagatcctgaagaacctgaagccggatctgatgatctacgatgtgctgcaacagtgggcagaacgtgttgcaaatgaacagagcatcccggcggttcgtctgctgaccttcggtgcagccgtatttagctacttttgtaacctggttaaaaaaccgggtgtcgaatttccgtttcccgacatctacctgcgcaagatcgaacaggttaaactgggcgagatgctggaaaagagcgcgaaagaccaagacccagacgatgaagaacgtctggtggatgaatacaagcagattgcactgatctgtacgagccgtaccattgaggcgaagtacattgatttcctgcttgaattgagcaacctgaaagtggttccagttggtagtccagtgcaggatctgattaccaatgacgcggatgatatggagctgattgattggcttggctcaaaagacgaaaacagcaccgttttcgttagcttcggtagcgagtacttcctgagcaaagaagatatggaagaagtggctttaggccttgaactgagcaatgtgaactttgtgtgggtcgcacgttttccgaaaggcgaagaacagaatctggaagatgcactgccgaaaggtttcctggaacgcattggtgaacgtggtcgtgttctggacaagtttgcgccgcagctgcgtattctgaaccacacgagcaccggcggttttattagccactgtggttggaatagcgtcatggagagcattcacttcggtgtgccgattgtggcgatgccgatgcacctggatcagccgatgaatgcacgcttgatcgtggagcttggtgttgcggtggagatcgtgcgcgacgacgatggcaagatttaccgcgaggagatcgcgaaaaccctgaaagatgtgattaccgagcgcatcggcgaaaacctgcgtgctaagatgcgcgagattagcaagaacctgaacagcattagcggtgaagaaatggacgcggcggcgcatgaactgatccagttttgtaagattagcaccaactaa

SEQ ID NO: 766 - protein, 464 aa, Artificial Sequence
  codon-optimized Solanum lycopersicum glycosyltransferase
MHHHHHHGGSGMGTQVTEHGTSNLRVVMFPWLAYGHISPFLYVAKKLADRGFLIYLCSTPINLKSTIEKIPEKYADSIHLIELHLPELPELPPHYHTTNGLPPHLNHTLQKALKMSKPNLSKILKNLKPDLMIYDVLQQWAERVANEQSIPAVRLLTFGAAVFSYFCNLVKKPGVEFPFPDIYLRKIEQVKLGEMLEKSAKDQDPDDEERLVDEYKQIALICTSRTIEAKYIDFLLELSNLKVVPVGSPVQDLITNDADDMELIDWLGSKDENSTVFVSFGSEYFLSKEDMEEVALGLELSNVNFVWVARFPKGEEQNLEDALPKGFLERIGERGRVLDKFAPQLRILNHTSTGGFISHCGWNSVMESIHFGVPIVAMPMHLDQPMNARLIVELGVAVEIVRDDDGKIYREEIAKTLKDVITERIGENLRAKMREISKNLNSISGEEMDAAAHELIQFCKISTN

SEQ ID NO: 767 - DNA, 1359 bp, Artificial Sequence
  codon-optimized Solanum lycopersicum glycosyltransferase
atgaacaaaccgcagagctgggaaacgcgtgcggaaacctatagcctgtatggttttaccgatatgccgagcctgcatcagcgtggcaccgtggtggtgacccatggcgaaggcccgtatatcgtggatgtgcatggccgtcgttatctggatgcgtgcagcggcgctgcgaacatggtggcgggctttgatcataaaggcctgattgatgcggcgaaaacgcagtatgaacgttttccgggctatcatgcggttaaaggccgtatgagcgatcagaccgtgatgctgtctgaaaaactggtggaagtgagcccgtttgatagcggccgtgtgttttataccaacagcggcagcgaagcgaacgataccatggtgaaaatgctgtggtttctgcatgcggcggaaggcaaaccgcagaaacgtaaaattctgacccattggaacgcgtatcatggcgcgaccgcggtgagcgcgagcatgaccggctttccgtataacagcgtgtttggcctgccgctgccgggctttctgcatctgacctgcccgcattattggcgttatggcgaagaaggcgaaaccgaagaacagtttgtcgcgcgtctggcccatgaactggaagaaaccattcagaaggaaggcgcggataccattgcgggcttttttgcggaaccggtgatgggtgcgggcggtgttattccgccggcaaaaggctattttcaggcgattctgccgatcctgcgcaaatatgatattccggtgatcagcgatgaagtgatttgcggcttcggccgtaccggtaacacctggggctgcgtgacctatgattttaccccggatgcgattattagcgcgaaaagcctaaccgcgggtttttttgcggtaggcgcggtgattctgggtccggaactgagcaaacgtctggaaaccgcgattgaagcgcgtgaatggtttccgcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggcattggctttatgtgggcgctggaagtcaggaaagataaagcgagcaaagccccgtttggtggcaacctgagcgtgagcgaacgtattgcgaacacctgcaccgatctgggcctgattgtgcgtgcgctgggccagagcgtggcgctgtgcccgccgtttattctgaccgaagcgcagatggatgaaatgttcgataaactggaaaaagcgctggataaagtgttcgcggaagtggcg

SEQ ID NO: 768 - protein, 453 aa, Artificial Sequence
  codon-optimized Solanum lycopersicum glycosyltransferase
MNKPQSWETRAETYSLYGFTDMPSLHQRGTVVVTHGEGPYIVDVHGRRYLDACSGAANMVAGFDHKGLIDAAKTQYERFPGYHAVKGRMSDQTVMLSEKLVEVSPFDSGRVFYTNSGSEANDTMVKMLWFLHAAEGKPQKRKILTHWNAYHGATAVSASMTGFPYNSVFGLPLPGFLHLTCPHYWRYGEEGETEEQFVARLAHELEETIQKEGADTIAGFFAEPVMGAGGVIPPAKGYFQAILPILRKYDIPVISDEVICGFGRTGNTWGCVTYDFTPDAIISAKSLTAGFFAVGAVILGPELSKRLETAIEAREWFPHGFTTGGHPVGCAIALKAIDVVMNEGLAENVRRLAPRFEERLKHIAERPNIGEYRGIGFMWALEVRKDKASKAPFGGNLSVSERIANTCTDLGLIVRALGQSVALCPPFILTEAQMDEMFDKLEKALDKVFAEVA

SEQ ID NO: 769 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 770 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 771 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccggtttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatccacctgtcgaaggtggaacaggtgaagatgcgcgagatgtttgaaaaggagccggacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgtggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 772 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIRFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIHLSKVEQVKMREMFEKEPDEEDRLAEGNMQIMLMCTSRTIEAKYLDYCTELSNWKVVPVGPPFQDPITNDVDDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 773 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccggtttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgccgaaggtggaacaggtgaagatgcgcgagatgtttgaaaaggagccggacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgtggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 774 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESTIKKIPEKYSESIRFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIYLPKVEQVKMREMFEKEPDEEDRLAEGNMQIMLMCTSRTIEAKYLDYCTELSNWKVVPVGPPFQDPITNDVDDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 775 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 776 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 777 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcattatcaagaagatcccggagaaatacagtgagagcatccgtttagtggagctgcatctgccagaattaccggaactgccaccacattaccatactaccaacggtttaccaccgcatctgaaccataccctgcacaaggcactgaagatgagcaagccgaactttagcaagatcctgcagaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgcctaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcggctggaaagttgttccggttggtccgccatttcaggacccgattactaatgatgttgacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcctggattttggcgttccgatcattgcgatgccgatgcacaacgatcagccgattaacgcgaagctgatcgtggaattaggcgttgcaatggagatcgtgcgtgatgacgatggcaacattcaccgcggcgaaattacggaaaccctgaaagatgtgattaccggcgaaactggtgaggtcctgcgcggcaaagtacgagacattagcaagaacctgaagagcattcgcgaggaagaaatgaatgcagcggcggaagaactgatccagctgtgtcgcaacagcaacaagtacaagtaa

SEQ ID NO: 778 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIRLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIYLPKVEQVKMREMFEKEPNEEDRLAEGNMQIMLMCTSRTIEAKYLDYCTELSGWKVVPVGPPFQDPITNDVDDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAMEIVRDDDGNIHRGEITETLKDVITGETGEVLRGKVRDISKNLKSIREEEMNAAAEELIQLCRNSNKYK

SEQ ID NO: 779 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcattatcaagaagatcccggagaaatacagtgagagcatccgtttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgcctaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcggctggaaagttgttccggttggtccgccatttcaggacccgattactaatgatgttgacgacatgggactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcctggattttggcgttccgatcattgcgatgccgatgcacaacgatcagccgattaacgcgaagctgatcgtggaattaggcgttgcaatggagatcgtgcgtgatgacgatggcaacattcaccgcggcgaaattacggaaaccctgaaagatgtgattaccggcgaaactggtgagatcctgcgcggcaaagtacgagacattagcaagaacctgaagagcattcgcgaggaagaaatgaatgcagcggcggaagaactgatccagctgtgtcgcaacagcaacaagtacaagtaa

SEQ ID NO: 780 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIRLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIYLPKVEQVKMREMFEKEPNEEDRLAEGNMQIMLMCTSRTIEAKYLDYCTELSGWKVVPVGPPFQDPITNDVDDMGLIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAMEIVRDDDGNIHRGEITETLKDVITGETGEILRGKVRDISKNLKSIREEEMNAAAEELIQLCRNSNKYK

SEQ ID NO: 781 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcattatcaagaagatcccggagaaatacagtgagagcatccgtttagtggagctgcatctgccagaattaccggaactgccaccacattaccatactaccaacggtttaccaccgcatctgaaccataccctgcacaaggcactgaagatgagcaagccgaactttagcaagatcctgcagaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgcctaaagtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcggctggaaagttgttccggttggtccgccatttcaggacccgattactaatgatgttgacgacccagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatcctagcacgggtggcttcatctctcattgcggttggaacagcgtcatggaaagcctggattttggcgttccgatcattgcgatgccgatgcacaacgatcagccgattaacgcgaagctgatcgtggaattaggcgttgcaatggagatcgtgcgtgatgacgatggcaacattcaccgcggcgaaattacggaaaccctgaaagatgtgattaccggcaaaactggtgaggtcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 782 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIRLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIYLPKVEQVKMREMFEKEPNEEDRLAEGNMQIMLMCTSRTIEAKYLDYCTELSGWKVVPVGPPFQDPITNDVDDPELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAMEIVRDDDGNIHRGEITETLKDVITGKTGEVLRGKVRDISKNLKSIREEEMNAAAEELIQLCRNSNKYK

SEQ ID NO: 783 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcattatcaagaagatcccggagaaatacagtgagagcatccgtttagtggagctgcatctgccagaattaccggaactgccaccacattaccatactaccaacggtttaccaccgcatctgaaccataccctgcacaaggcactgaagatgagcaagccgaactttagcaagatcctgtccaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgcctaaagtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcggctggaaagttgttccggttggtccgccatttcaggacccgattactaatgatgttgacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatcctagcacgggtggcttcatctctcattgcggttggaacagcgtcatggaaagcctggattttggcgttccgatcattgcgatgccgatgcacaacgatcagccgattaacgcgaagctgatcgtggaattaggcgttgcaatggagatcgtgcgtgatgacgatggcaacattcaccgcggcgaaattacggaaaccctgaaagatgtgattaccggcaaaactggtgagatcctgcgcggcaaagtacgagacattagcaagaacctgaagagcattcgcgaggaagaaatgaatgcagcggcggaagaactgatccagctgtgtcgcaacagcaacaagtacaagtaa

SEQ ID NO: 784 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIRLVELHLPELPELPPHYHTTNGLPPHLNHTLHKALKMSKPNFSKILSNLKPDLVIYDILQPWAEHVVNEQNIPAVKILTSGAALFSYFFNFLKNPGVEFPFPAIYLPKVEQVKMREMFEKEPNEEDRLAEGNMQIMLMCTSRTIEAKYLDYCTELSGWKVVPVGPPFQDPITNDVDDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAMEIVRDDDGNIHRGEITETLKDVITGKTGEILRGKVRDISKNLKSIREEEMNAAAEELIQLCRNSNKYK

SEQ ID NO: 785 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcattatcaagaagatcccggagaaatacagtgagagcatccgttttgtggagctgacactgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgcctaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagtggttccggttggtccgccatttcaggacccgattactaatgatgttgacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccagatggcttcctggaacgcattggtgaacgtggtcgcgttctggacaagtttgcaccgcagccacgtattctgaaccatccgagcacgggtggcttcatctctcattgcggttggaacagcgtcatggaaagcctggattttggcgttccgatcattgcgatgccgatgcacaacgatcagccgattaacgcgaagctgatcgtggaattaggcgttgcaatggagatcgtgcgtgatgacgatggcaacattcaccgcgaagaaattacggaaaccctgaaagatgtgattaccggcgaaactggtgagatcctgcgcggcaaagtacgcgacattagcaaaagcctgaagagcattcgcgaggaagaaatgaatgcagcggcggaagaactgatccagctgtgtcgcaacagcaacaagtacaagtaa

SEQ ID NO: 786 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIRFVELTLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIYLPKVEQVKMREMFEKEPNEEDRLAEGNMQIMLMCTSRTIEAKYLDYCTELSNWKVVPVGPPFQDPITNDVDDMELIDWLGTKDENSTVFVCFGSEYFLSREDMEEVAFGLELSNVNFIWVARFPKGEEQNLEDVLPDGFLERIGERGRVLDKFAPQPRILNHPSTGGFISHCGWNSVMESLDFGVPIIAMPMHNDQPINAKLIVELGVAMEIVRDDDGNIHREEITETLKDVITGETGEILRGKVRDISKSLKSIREEEMNAAAEELIQLCRNSNKYK

SEQ ID NO: 787 - DNA, 1356 bp, Artificial Sequence
  Glycosyltransferase Variant of SEQ ID NO: 758
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcattatcaagaagatcccggagaaatacagtgagagcatccgttttgtggagctgacactgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgcctaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagtggttccggttggtccgccatttcaggacccgattactaatgatgttgacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcctggattttggcgttccgatcattgcgatgccgatgcacaacgatcagccgattaacgcgaagctgatcgtggaattaggcgttgcaatggagatcgtgcgtgatgacgatggcaacattcaccgcgaagaaattacggaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 788 - protein, 451 aa, Artificial Sequence
  Glycosyltransferase Variant of SEQ ID NO: 758
MHHHHHHGGSGATLRVLMFPWLAYGHISPFLNIAKQLADRGFLIYLCSTLINLESIIKKIPEKYSESIRFVELTLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIYLPKVEQVKMREMFEKEPNEEDRLAEGNMQIMLMCTSRTIEAKYLDYCTELSNWKVVPVGPPFQDPITNDVDDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAMEIVRDDDGNIHREEITETLKDVITGETGEILRGKVRDISKNLKSIREEEMNAAAEELIQLCRNSNKYK

SEQ ID NO: 789 - DNA, 1356 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaagtaa

SEQ ID NO: 790 - protein, 451 aa, Artificial Sequence
  ADP-Glycosyltransferase Variant of SEQ ID NO: 770
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 791 - DNA, 1356 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaagtaa

SEQ ID NO: 792 - protein, 451 aa, Artificial Sequence
  ADP-Glycosyltransferase Variant of SEQ ID NO: 770
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 793 - DNA, 1356 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 794 - protein, 451 aa, Artificial Sequence
  ADP-Glycosyltransferase Variant of SEQ ID NO: 770
MHHHHHHGGSGATLRVLMFPWLAYGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 795 - DNA, 1356 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatattagcccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaagtaa

SEQ ID NO: 796 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 797 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatattagcccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgagctttggcagcgaatacttcctgagccgtgaagacatggaagaagtcgcgttcggcctggagctgagcaacgtgaactttgtttgggtggcgcgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 798 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVSFGSEYFLSREDMEEVAFGLELSNVNFVWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 799 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcggagggtcatattagcccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgagctttggcagcgaatacttcctgagccgtgaagacatggaagaagtcgcgttcggcctggagctgagcaacgtgaactttatttgggtggtgcgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 800 - protein, 451 aa, Artificial Sequence
  ADP-Glycosyltransferase Variant of SEQ ID NO: 770
MHHHHHHGGSGATLRVLMFPWLAEGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVSFGSEYFLSREDMEEVAFGLELSNVNFIWVVRFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 801 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 802 - protein, 451 aa, Artificial Sequence
  ADP-Glycosyltransferase Variant of SEQ ID NO: 770
MHHHHHHGGSGATLRVLMFPWLAYGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 803 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 804 - protein, 451 aa, Artificial Sequence
  ADP-Glycosyltransferase Variant of SEQ ID NO: 770
MHHHHHHGGSGATLRVLMFPWLAYGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 805 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgtgctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 806 - protein, 451 aa, Artificial Sequence
  ADP-Glycosyltransferase Variant of SEQ ID NO: 770
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 807 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 808 - protein, 451 aa, Artificial Sequence
  ADP-Glycosyltransferase Variant of SEQ ID NO: 770
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 809 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcggttggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 810 - protein, 451 aa, Artificial Sequence
  ADP-Glycosyltransferase Variant of SEQ ID NO: 770
MHHHHHHGGSGATLRVLMFPWLAVGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 811 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtggcgtttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 812 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVAFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 813 - DNA, 1356 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgcttggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 814 - protein, 451 aa, Artificial Sequence
  ADP-Glycosyltransferase Variant of SEQ ID NO: 770
MHHHHHHGGSGATLRVLMFPWLALGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 815 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatattctgccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 816 - protein, 451 aa, Artificial Sequence
  ADP-Glycosyltransferase Variant of SEQ ID NO: 770
MHHHHHHGGSGATLRVLMFPWLAYGHILPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 817 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtctttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 818 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSESFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 819 - DNA, 1356 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 820 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 821 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgacgaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 822 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMTNDQPINAKLIVELGVAVEIVRDDDGNIHRGEIAETLKDVITGETGEILRGKVRDISKNLKSIREEEMNAAAEELIQLCRNSNKYK

SEQ ID NO: 823 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatattgggccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 824 - protein, 451 aa, Artificial Sequence
  ADP-Glycosyltransferase Variant of SEQ ID NO: 770
MHHHHHHGGSGATLRVLMFPWLAYGHIGPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 825 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgtgtatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 826 - protein, 451 aa, Artificial Sequence
  ADP-Glycosyltransferase Variant of SEQ ID NO: 770
MHHHHHHGGSGATLRVLMFPWLAYGHISPFLCIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 827 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacggttttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 828 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDGFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 829 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtggttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 830 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEWFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 831 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgagtatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 832 - protein, 451 aa, Artificial Sequence
  ADP-Glycosyltransferase Variant of SEQ ID NO: 770
MHHHHHHGGSGATLRVLMFPWLAYGHISPFLSIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 833 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcttggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 834 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVLESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 835 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgctgaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 836 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMLNDQPINAKLIVELGVAVEIVRDDDGNIHRGEIAETLKDVITGETGEILRGKVRDISKNLKSIREEEMNAAAEELIQLCRNSNKYK

SEQ ID NO: 837 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgcggatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 838 - protein, 451 aa, Artificial Sequence
  ADP-Glycosyltransferase Variant of SEQ ID NO: 770
MHHHHHHGGSGATLRVLMFPWLAYGHISPFLRIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 839 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgggttttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 840 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVGFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 841 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 842 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDHFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 843 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcgtgatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 844 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGVISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 845 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatattaagccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 846 - protein, 451 aa, Artificial Sequence
  ADP-Glycosyltransferase Variant of SEQ ID NO: 770
MHHHHHHGGSGATLRVLMFPWLAYGHIKPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 847 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 848 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 849 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 850 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 851 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccatttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 852 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 853 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 854 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 855 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 856 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 857 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 858 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 859 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 860 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 861 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 862 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 863 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 864 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 865 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 866 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 867 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 868 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 869 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 870 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 871 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 872 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 873 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 874 - protein, 451 aa, Artificial Sequence; identical to SEQ ID NO: 776
  ADP-Glycosyltransferase Variant of SEQ ID NO: 770

SEQ ID NO: 875 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 876 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 877 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagtttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 878 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 879 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 880 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 881 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 882 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 883 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 884 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 885 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagtttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 886 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 887 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagtttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 888 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 889 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 890 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 891 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 892 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 893 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgagattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 894 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 895 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 896 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 897 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagtttgtggagctgcatttgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 898 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 899 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 900 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 901 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 902 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 903 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 904 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 905 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 906 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 907 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 908 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 909 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 910 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 911 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 912 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 913 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactatctcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtgcgcgacattagcaagaacctgaagagcattcgcgaggaagaaatgaatgcagcggcggaagaactgatccagctgtgtcgcaacagcaacaagtacaag

SEQ ID NO: 914 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSRTIEAKYLDYLTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 915 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 916 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 917 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatattgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgggttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgccgtggagatcgtgcgtgatgacgatggcaacattcaccgcggcgaaattgccgaaaccctgagagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 918 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLRDVITGETGEILRGKVRDISKNLKSIREEEMNAAAEELIQLCRNSNKYK

SEQ ID NO: 919 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 920 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 921 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 922 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 923 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 924 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 925 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 926 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 927 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 928 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 929 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagtttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 930 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 931 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatattgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 932 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 933 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 934 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 935 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 936 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 937 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccatttcgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 938 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 939 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 940 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 941 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 942 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 943 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgattcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 944 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPIHNDQPINAKLIVELGVAVEIVRDDDGNIHRGEIAETLKDVITGETGEILRGKVRDISKNLKSIREEEMNAAAEELIQLCRNSNKYK

SEQ ID NO: 945 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 946 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 947 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccagttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 948 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIQLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 949 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 950 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 951 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcaccatcaagaagatcccggagaaatacagtgagagcatccatttagtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 952 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESTIKKIPEKYSESIHLVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 953 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 954 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 955 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagccttgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 956 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESLDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 957 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 958 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMQNDQPINAKLIVELGVAVEIVRDDDGNIHRGEIAETLKDVITGETGEILRGKVRDISENLKSIREEEMNAAAEELIQLCRNSNKYK

SEQ ID NO: 959 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcatggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 960 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVMESIDFGVPIIAMPMQNDQPINAKLIVELGVAVEIVRDDDGNIHRGEIAETLKDVITGETGEILRGKVRDISENLKSIREEEMNAAAEELIQLCRNSNKYK

SEQ ID NO: 961 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 962 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDKFAPQPRILNHPSTGGFISHCGWNSVMESIDFGVPIIAMPMQNDQPINAKLIVELGVAVEIVRDDDGNIHRGEIAETLKDVITGETGEILRGKVRDISENLKSIREEEMNAAAEELIQLCRNSNKYK

SEQ ID NO: 963 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 964 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 965 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagcagcgtattctgaaccatccgagcacgggtggcttcatctctcattgcggttggaacagcgtcatggaaagccttgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 966 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDKFAPQQRILNHPSTGGFISHCGWNSVMESLDFGVPIIAMPMQNDQPINAKLIVELGVAVEIVRDDDGNIHRGEIAETLKDVITGETGEILRGKVRDISENLKSIREEEMNAAAEELIQLCRNSNKYK

SEQ ID NO: 967 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgagcaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 968 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPNEEDRLAEGNMQIMLMCTSRTIEAKYLDYCTELSNWKVVPVGPPFQDPITNDADDMELIDWLGTKDENSTVYVSFGSEYFLSREDMEEVAFGLELSNVNFIWVARFPKGEEQNLEDVLPKGFLERIGERGRVLDHFAPQQRILNHPSTGGFISHCGWNSVLESIDFGVPIIAMPMQNDQPINAKLIVELGVAVEIVRDDDGNIHRGEIAETLKDVITGETGEILRGKVRDISENLKSIREEEMNAAAEELIQLCRNSNKYK

SEQ ID NO: 969 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcgttaggtcatattaacccgtttttgagcatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaaagcttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttggcgtggaggttgtgcgtgatgaagatggcaacattcaccgcggcgaaattgccgaaaccattaaagatgtgatgaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 970 - protein, 451 aa, Artificial Sequence
  ADP-Glycosyltransferase Variant of SEQ ID NO: 792
MHHHHHHGGSGATLRVLMFPWLALGHINPFLSIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVSFGSESFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVGVEVVRDEDGNIHRGEIAETIKDVMTGETGEILRGKVRDISENLKSIREEEMNAAAEELIQLCRNSNKYK

SEQ ID NO: 971 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcgttaggtcatattaacccgtttttgagcatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagcagcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 972 - protein, 451 aa, Artificial Sequence
  ADP-Glycosyltransferase Variant of SEQ ID NO: 792
MHHHHHHGGSGATLRVLMFPWLALGHINPFLSIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVSFGSEYFLSREDMEEVAFGLELSNVNFIWVARFPKGEEQNLEDVLPKGFLERIGERGRVLDKFAPQQRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 973 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcgttaggtcatattaacccgtttttgagcatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtggcgtttggcagcgaaagcttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagcagcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccgttagagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 974 - protein, 451 aa, Artificial Sequence
  ADP-Glycosyltransferase Variant of SEQ ID NO: 792
MHHHHHHGGSGATLRVLMFPWLALGHINPFLSIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVAFGSESFLSREDMEEVAFGLELSNVNFIWVARFPKGEEQNLEDVLPKGFLERIGERGRVLDKFAPQQRILNHPSTGGFISHCGWNSVMESLDFGVPIIAMPMHNDQPINAKLIVELGVAVEIVRDDDGNIHRGEIAETVRDVITGETGEILRGKVRDISENLKSIREEEMNAAAEELIQLCRNSNKYK

SEQ ID NO: 975 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcgttaggtcatattaacccgtttttgagcatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtggcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagcagcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 976 - protein, 451 aa, Artificial Sequence
  ADP-Glycosyltransferase Variant of SEQ ID NO: 792
MHHHHHHGGSGATLRVLMFPWLALGHINPFLSIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVAFGSEYFLSREDMEEVAFGLELSNVNFIWVARFPKGEEQNLEDVLPKGFLERIGERGRVLDKFAPQQRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 977 - DNA, 1356 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcgagattgaggctaagtacctggactattgcaccgaactgagcaattggaaagttgttccggttggtccgccatttcaggacccgattactaatgatgcggacgacatggaactgattgattggttaggcaccaaagacgagaacagtgtggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaagtaa

SEQ ID NO: 978 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSREIEAKYLDYCTELSNWKVVPVGPPFQDPITNDADDMELIDWLGTKDENSVVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 979 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactatctaaccgaactgagcaattggaaagttgttccggttggtccgccatttcaggacccgattactaatgatgcggacgacatggaactgattgattggttaggcaccaaagacgagaacagtgtggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 980 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSRTIEAKYLDYLTELSNWKVVPVGPPFQDPITNDADDMELIDWLGTKDENSVVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 981 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcgttaggtcatattaacccgtttttgagcatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaaagcttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaacccttagagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 982 - protein, 451 aa, Artificial Sequence
  ADP-Glycosyltransferase Variant of SEQ ID NO: 792
MHHHHHHGGSGATLRVLMFPWLALGHINPFLSIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVSFGSESFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLRDVITGETGEILRGKVRDISENLKSIREEEMNAAAEELIQLCRNSNKYK

SEQ ID NO: 983 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcgttaggtcatattaacccgtttttgagcatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtgagctttggcagcgaaagcttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 984 - protein, 451 aa, Artificial Sequence
  ADP-Glycosyltransferase Variant of SEQ ID NO: 792
MHHHHHHGGSGATLRVLMFPWLALGHINPFLSIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVSFGSESFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 985 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcactattgaggctaagtacctggactatctaaccgaactgagcaattggaaagttgttccggttggtccgccgtttcaggacccgattactaatgatgcggacgacatggaactgattgattggttaggtaccaaagacgagaacagtaccgtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 986 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSRTIEAKYLDYLTELSNWKVVPVGPPFQDPITNDADDMELIDWLGTKDENSTVYVSFGSEYFLSREDMEEVAFGLELSNVNFIWVARFPKGEEQNLEDVLPKGFLERVGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 987 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcgttaggtcatattaacccgtttttgagcatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtggcgtttggcagcgaaagcttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttggcgtggagattgtgcgtgatgatgatggcaacattcaccgcggcgaaattgccgaaacccttagagatgtgatgaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 988 - protein, 451 aa, Artificial Sequence
  ADP-Glycosyltransferase Variant of SEQ ID NO: 792
MHHHHHHGGSGATLRVLMFPWLALGHINPFLSIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVAFGSESFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVGVEIVRDDDGNIHRGEIAETLRDVMTGETGEILRGKVRDISENLKSIREEEMNAAAEELIQLCRNSNKYK

SEQ ID NO: 989 - DNA, 1356 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcactattgaggctaagtacctggactatctaaccgaactgagcaattggaaagttgttccggttggtccgccgtttcaggacccgattactaatgatgcggacgacatggaactgattgattggttaggcaccaaagacgagaacagtgtggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaagtaa

SEQ ID NO: 990 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYLTELSNWKVVPVGPPFQDPITNDADDMELIDWLGTKDENSVVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 991 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcgagattgaggctaagtacctggactatctaaccgaactgagcaattggaaagttgttccggttggtccgccatttcaggacccgattactaatgatgcggacgacatggaactgattgattggttagataccaaagacgagaacagtacggtctatgtgagctttggcagcgaatacttcctgagccgtgaagacatggaagaagtggcgttcggcctggagctgagcaacgtgaactttatctgggttgcacgctttccgaaaggcgaggaacagaatctggaagacgttctgccaaaaggcttcctggaacgcgttggtgaacgtggtcgcgttctggacaagtttgcaccgcagccgcgtattctgaaccatccgagcacgggtggcttcctttctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 992 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSREIEAKYLDYLTELSNWKVVPVGPPFQDPITNDADDMELIDWLDTKDENSTVYVSFGSEYFLSREDMEEVAFGLELSNVNFIWVARFPKGEEQNLEDVLPKGFLERVGERGRVLDKFAPQPRILNHPSTGGFLSHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 993 - DNA, 1356 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcgagattgaggctaagtacctggactatctaaccgaactgagcaattggaaagttgttccggttggtccgccatttcaggacccgattactaatgatgcggacgacatggaactgattgattggttaggcaccaaagacgagaacagtaccgtctatgtgagctttggcagcgaatacttcctgagccgtgaacaaatggaagaactggcgttcggcctggagctgagcaacgtgaactttatctgggttgcacgctttccgaaaggcgaggaacagaatctggaagacgttctgccaaaaggcttcctggaacgcattggtgaacgtggtcgcgttgtggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaagtaa

SEQ ID NO: 994 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPNEEDRLAEGNMQIMLMCTSREIEAKYLDYLTELSNWKVVPVGPPFQDPITNDADDMELIDWLGTKDENSTVYVSFGSEYFLSREQMEELAFGLELSNVNFIWVARFPKGEEQNLEDVLPKGFLERIGERGRVVDKFAPQPRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 995 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactatctaaccgaactgagcaattggaaagttgttccggttggtccgccatttcaggacccgattactaatgatgcggacgacatggaactgattgattggttaggcaccaaagacgagaacagtgtggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 996 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYLTELSNWKVVPVGPPFQDPITNDADDMELIDWLGTKDENSVVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISENLKSIREEEMNAAAEELIQLCRNSNKYK

SEQ ID NO: 997 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcactattgaggctaagtacctggactatctaaccgaactgagcaattggaaagttgttccggttggtccgccatttcaggacccgattactaatgatgcggacgacatggaactgattgattggttaggcaccaaagacgagaacagtgtggtctatgtgagctttggcagcgaatacttcctgagccgtgaagacatggaagaagtggcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 998 - protein, 451 aa, Artificial Sequence
  ADP-Glycosyltransferase Variant of SEQ ID NO: 792
MHHHHHHGGSGATLRVLMFPWLAEGHINPFLNIAKQLADRGFLIYLCSTLINLESVIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYLTELSNWKVVPVGPPFQDPITNDADDMELIDWLGTKDENSVVYVSFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 999 - DNA, 1353 bp, Artificial Sequence
  ADP-Glycosyltransferase Variant of SEQ ID NO: 792
atgcaccatcatcatcatcatggcggtagcggcgctaccctgcgcgtactgatgtttccgtggcttgcgttaggtcatattaacccgtttttgaacatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctatgtggcgtttggcagcgaaagcttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccgcgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagattgtgcgtgatgaagatggcaacattcaccgcggcgaaattgccgaaaccgttaaagatgtgatgaccggcgaaactggtgagatcctgcgcggcaaagtacgcgacattagcgaaaacctgaagagcattcgcgaggaagaaatgaatgcagcggcggaagaactgatccagctgtgtcgcaacagcaacaagtacaag

SEQ ID NO: 1000 - protein, 451 aa, Artificial Sequence
  ADP-Glycosyltransferase Variant of SEQ ID NO: 792
MHHHHHHGGSGATLRVLMFPWLALGHINPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVYVAFGSESFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDEDGNIHRGEIAETVKDVMTGETGEILRGKVRDISENLKSIREEEMNAAAEELIQLCRNSNKYK

SEQ ID NO: 1001 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1002 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1003 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgccgtggaggttgtgcgtgatgaagatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1004 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEVVRDEDGNIHRGEIAETLKDVITGETGEILRGKVRDISKNLKSIREEEMNAAAEELIQLCRNSNKYK

SEQ ID NO: 1005 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtggcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgaagatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1006 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESVIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEEVAFGLELSNVNFIWVARFPKGEEQNLEDVLPKGFLERVGERGRVLDHFAPQPRILNHPSTGGFISHCGWNSVLESIDFGVPIIAMPMQNDQPINAKLIVELGVAVEIVRDEDGNIHRGEIAETLKDVITGETGEILRGKVRDISKNLKSIREEEMNAAAEELIQLCRNSNKYK

SEQ ID NO: 1007 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttaccggaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttagataccaaagacgagaacagtacggtctatgtgagctttggcagcgaatacttcctgagccgtgaagatatggaagaagtggcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgccgtggaggttgtgcgtgatgaagatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1008 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESVIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLPEGNMQIMLMCTSRTIEAKYLDYCTELSNWKVVPVGPPFQDPITNDADDKELIDWLDTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEVVRDEDGNIHRGEIAETLKDVITGETGEILRGKVRDISKNLKSIREEEMNAAAEELIQLCRNSNKYK

SEQ ID NO: 1009 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttaccggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1010 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLPEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETIKDVITGETGEILRGKVRDISKNLKSIREEEMNAAAEELIQLCRNSNKYK

SEQ ID NO: 1011 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccattagagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1012 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETIRDVITGETGEILRGKVRDISKNLKSIREEEMNAAAEELIQLCRNSNKYK

SEQ ID NO: 1013 - DNA, 1356 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtgagctttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagcagcgtattctgaaccatccgagcacgggtggcttcatttctcattgcggttggaacagcgtcctggaaagcattgattttggcgttccgatcattgcgatgccgatgcagaacgatcagccgattaacgcgaagctgatcgtggaattaggcgttgccgtggagattgtgcgtgatgatgatggcaacattcaccgcggcgaaattgccgaaaccattagagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaagtaa

SEQ ID NO: 1014 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVSFGSEYFLSREDMEELAFGLELSNVNFIWVARFPKGEEQNLEDVLPKGFLERIGERGRVVDHFAPQQRILNHPSTGGFISHCGWNSVLESIDFGVPIIAMPMQNDQPINAKLIVELGVAVEIVRDDDGNIHRGEIAETIRDVMTGETGEILRGKVRDISKNLKSIREEEMNAAAEELIQLCRNSNKYK

SEQ ID NO: 1015 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttaccggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatttctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1016 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLPEGNMQIMLMCTSREIEAKYLDYCTELSNWKVVPVGPPFQDPITNDADDKELIDWLGTKDENSTVYVAFGSEYFLSREDMEEVAFGLELSNVNFIWVARFPKGEEQNLEDVLPKGFLERIGERGRVLDHFAPQQRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1017 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttggcgtggagattgtgcgtgatgatgatggcaacattcaccgcggcgaaattgccgaaaccattagagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1018 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVLESIDFGVPIIAMPMQNDQPINAKLIVELGVGVEIVRDDDGNIHRGEIAETIRDVMTGETGEILRGKVRDISKNLKSIREEEMNAAAEELIQLCRNSNKYK

SEQ ID NO: 1019 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttagagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1020 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETLRDVMTGETGEILRGKVRDISKNLKSIREEEMNAAAEELIQLCRNSNKYK

SEQ ID NO: 1021 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttaccggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttggcgtggaggttgtgcgtgatgatgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1022 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESVIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLPEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQQRILNHPSTGGFISHCGWNSVLESIDFGVPIIAMPMQNDQPINAKLIVELGVGVEVVRDDDGNIHRGEIAETLKDVITGETGEILRGKVRDISKNLKSIREEEMNAAAEELIQLCRNSNKYK

SEQ ID NO: 1023 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtggcgtttggcagcgaatacttcctgagccgtgaagatatggaagaagtggcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagcagcgtattctgaaccatccgagcacgggtggcttcatttctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1024 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVYVAFGSEYFLSREDMEEVAFGLELSNVNFIWVARFPKGEEQNLEDVLPKGFLERIGERGRVVDHFAPQQRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1025 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttaccggaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1026 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLPEGNMQIMLMCTSRTIEAKYLDYCTELSNWKVVPVGPPFQDPITNDADDKELIDWLGTKDENSTVYVSFGSEYFLSREDMEELAFGLELSNVNFIWVARFPKGEEQNLEDVLPKGFLERIGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1027 - DNA, 1356 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagcggccgggtgtagaatttccgtttccggcgatcaacctgccgaaggtggaacaggtgaagatgcgcgagatgtttgaaaaggagccggatgaagaagatcgcttagcagagggcaatatgcaaatcatgctgatgtgcacgagccgcaccattgaggctaagtacctggactatttgaccgaactgagcaatgtcaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaagtaa

SEQ ID NO: 1028 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAEGNMQIMLMCTSRTIEAKYLDYLTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1029 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtggcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggaggttgtgcgtgatgaagatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1030 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESVIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVYVAFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEVVRDEDGNIHRGEIAETLKDVITGETGEILRGKVRDISKNLKSIREEEMNAAAEELIQLCRNSNKYK

SEQ ID NO: 1031 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatgcactgcaaccgtgggcagaacatgtcgtaaacgaacagaacatcccggctgttaagattctgaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcaccgggcaatggtcaaatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1032 - protein, 451 aa, Artificial Sequence
  ADP-Glycosyltransferase Variant of SEQ ID NO: 954
MHHHHHHGGSGATLRVLMFPWLALGHINPFLSIAKQLADRGFLIYLCSTLINLESIIKKIPEKYSESIHLVELHLPELPELPPHYHTTNGLPPHLNHTLHKALKMSKPNFSKILQNLKPDLVIYDALQPWAEHVVNEQNIPAVKILTSGAALFSYFFNFLKNPGVEFPFPAINLPKVEQVKMREMFEKEPDEEDRLAPGNGQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1033 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtgagctttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagcagcgtattctgaaccatccgagcacgggtggcttcatttctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1034 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESVIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSREIEAKYLDYCTELSNWKVVPVGPPFQDPITNDADDKELIDWLGTKDENSTVYVSFGSEYFLSREDMEELAFGLELSNVNFIWVARFPKGEEQNLEDVLPKGFLERIGERGRVVDHFAPQQRILNHPSTGGFISHCGWNSVLESIDFGVPIIAMPMQNDQPINAKLIVELGVAVEIVRDDDGNIHRGEIAETIKDVITGETGEILRGKVRDISKNLKSIREEEMNAAAEELIQLCRNSNKYK

SEQ ID NO: 1035 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcaccgggcaatatgggtatcatgctgatgtgcacgagccgcaccattgaggctaagtacctggactattgcaccgaactgagcaatgtcaaagttgttccggttggtccgccatttcaggacccgattactaatgatgcggacgacaaagaactgattgattggttaggcaccaaagacgagaacagtgtagtctatgtgagctttggcagcgaatatttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1036 - protein, 451 aa, Artificial Sequence
  ADP-Glycosyltransferase Variant of SEQ ID NO: 954
MHHHHHHGGSGATLRVLMFPWLAEGHINPFLSIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNMGIMLMCTSRTIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1037 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcaccgggcaatggtcaaatcatgctgatgtgcacgagccgcaccattgaggctaagtacctggactattgtaccgaactgagcaatgtcaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1038 - protein, 451 aa, Artificial Sequence
  ADP-Glycosyltransferase Variant of SEQ ID NO: 954
MHHHHHHGGSGATLRVLMFPWLALGHINPFLSIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGQIMLMCTSRTIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1039 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaagtggcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttggcgtggaggttgtgcgtgatgaagatggcaacattcaccgcggcgaaattgccgaaaccgttaaagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1040 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESVIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVYVAFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVGVEVVRDEDGNIHRGEIAETVKDVMTGETGEILRGKVRDISKNLKSIREEEMNAAAEELIQLCRNSNKYK

SEQ ID NO: 1041 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcaccgggcaatggtcaaatcatgctgatgtgcacgagccgcaccattgaggctaagtacctggactattgtaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1042 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1043 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattgccaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgtaccgaactgagcaatgtcaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1044 - protein, 451 aa, Artificial Sequence
  ADP-Glycosyltransferase Variant of SEQ ID NO: 954
MHHHHHHGGSGATLRVLMFPWLALGHINPFLSIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKIATSGAALFSYFFNFLKNPGVEFPFPAINLPKVEQVKMREMFEKEPDEEDRLAEGNMQIMLMCTSRTIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1045 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgaagatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1046 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDEDGNIHRGEIAETLKDVITGETGEILRGKVRDISKNLKSIREEEMNAAAEELIQLCRNSNKYK

SEQ ID NO: 1047 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagagggcaatggtggtatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatatttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1048 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNGGIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1049 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtggcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttggcgtggagattgtgcgtgatgatgatggcaacattcaccgcggcgaaattgccgaaacccttaaagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1050 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVGVEIVRDDDGNIHRGEIAETLKDVMTGETGEILRGKVRDISKNLKSIREEEMNAAAEELIQLCRNSNKYK

SEQ ID NO: 1051 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcaccgggcaatggtcaaatcatgctgatgtgcacgagccgcaccattgaggctaagtacctggactatttgaccgaactgagcaatgtcaaagttgttccggttggtccgccatttcaggacccgattactaatgatgcggacgacaaagaactgattgattggttaggcaccaaagacgagaacagtacggtctatgtgagctttggcagcgaatatttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1052 - protein, 451 aa, Artificial Sequence
  ADP-Glycosyltransferase Variant of SEQ ID NO: 954
MHHHHHHGGSGATLRVLMFPWLALGHINPFLSIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGQIMLMCTSRTIEAKYLDYLTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1053 - DNA, 1356 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagagggcaatatgggtatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaagtaa

SEQ ID NO: 1054 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMGIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1055 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagagggcaatatgcaaatcatgctgatgtgcacgagccgcaccattgaggctaagtacctggactattgtaccgaactgagcaattggaaagttgttccggttggtccgccatttcaggacccgattactaatgatgcggacgacaaagaactgattgattggttaggcaccaaagacgagaacagtgtagtctatgtgagctttggcagcgaatatttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1056 - protein, 451 aa, Artificial Sequence
  ADP-Glycosyltransferase Variant of SEQ ID NO: 954
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNWKVVPVGPPFQDPITNDADDKELIDWLGTKDENSVVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1057 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtggcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagcagcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttagagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1058 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVYVAFGSEYFLSREDMEEVAFGLELSNVNFIWVARFPKGEEQNLEDVLPKGFLERVGERGRVVDHFAPQQRILNHPSTGGFISHCGWNSVLESIDFGVPIIAMPMQNDQPINAKLIVELGVAVEIVRDDDGNIHRGEIAETLRDVMTGETGEILRGKVRDISKNLKSIREEEMNAAAEELIQLCRNSNKYK

SEQ ID NO: 1059 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttaccggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgtcgtttggcagcgaatacttcctgagccgtgaagatatggaagaagtggcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcctttctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1060 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLPEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERVGERGRVLDHFAPQPRILNHPSTGGFLSHCGWNSVLESIDFGVPIIAMPMQNDQPINAKLIVELGVAVEIVRDDDGNIHRGEIAETLKDVMTGETGEILRGKVRDISKNLKSIREEEMNAAAEELIQLCRNSNKYK

SEQ ID NO: 1061 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagagggcaatatgggtatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatatttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1062 - protein, 451 aa, Artificial Sequence
  ADP-Glycosyltransferase Variant of SEQ ID NO: 954
MHHHHHHGGSGATLRVLMFPWLAEGHINPFLSIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMGIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1063 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttaccggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtgagctttggcagcgaatacttcctgagccgtgaagatatggaagaagtggcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatttctcattgcggttggaacagcgtcctggaaagcattgattttggcgttccgatcattgcgatgccgatgcagaacgatcagccgattaacgcgaagctgatcgtggaattaggcgttggcgtggagattgtgcgtgatgaagatggcaacattcaccgcggcgaaattgccgaaaccattagagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1064 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLPEGNMQIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERVGERGRVLDHFAPQPRILNHPSTGGFISHCGWNSVLESIDFGVPIIAMPMQNDQPINAKLIVELGVGVEIVRDEDGNIHRGEIAETIRDVITGETGEILRGKVRDISKNLKSIREEEMNAAAEELIQLCRNSNKYK

SEQ ID NO: 1065 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgtaccgaactgagcaatgtcaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1066 - protein, 451 aa, Artificial Sequence
  ADP-Glycosyltransferase Variant of SEQ ID NO: 954
MHHHHHHGGSGATLRVLMFPWLAEGHINPFLSIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSRTIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1067 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcggaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttagataccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1068 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESVIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMQIMLMCTSREIEAKYLDYCTELSNWKVVPVGPPFQDPITNDADDKELIDWLDTKDENSTVYVSFGSEYFLSREDMEEVAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1069 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatgcactgcaaccgtgggcagaacatgtcgtaaacgaacagaacatcccggctgttaagattctgaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcaccgggcaatatgggtatcatgctgatgtgcacgagccgcaccattgaggctaagtacctggactatttgaccgaactgagcaatgtcaaagttgttccggttggtccgccatttcaggacccgattactaatgatgcggacgacaaagaactgattgattggttaggcaccaaagacgagaacagtgtagtctatgtgagctttggcagcgaatctttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1070 - protein, 451 aa, Artificial Sequence
  ADP-Glycosyltransferase Variant of SEQ ID NO: 954
MHHHHHHGGSGATLRVLMFPWLALGHINPFLSIAKQLADRGFLIYLCSTLINLESIIKKIPEKYSESIHLVELHLPELPELPPHYHTTNGLPPHLNHTLHKALKMSKPNFSKILQNLKPDLVIYDALQPWAEHVVNEQNIPAVKILTSGAALFSYFFNFLKNPGVEFPFPAINLPKVEQVKMREMFEKEPDEEDRLAPGNMGIMLMCTSRTIEAKYLDYLTELSNVKVVPVGPPFQDPITNDADDKELIDWLGTKDENSVVYVSFGSESFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1071 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcaccgggcaatatgggtatcatgctgatgtgcacgagccgcaccattgaggctaagtacctggactatttgaccgaactgagcaattggaaagttgttccggttggtccgccatttcaggacccgattactaatgatgcggacgacaaagaactgattgattggttaggcaccaaagacgagaacagtacggtctatgtgagctttggcagcgaatctttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1072 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNMGIMLMCTSRTIEAKYLDYLTELSNWKVVPVGPPFQDPITNDADDKELIDWLGTKDENSTVYVSFGSESFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 1073 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtggcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatttctcattgcggttggaacagcgtcctggaaagcattgattttggcgttccgatcattgcgatgccgatgcagaacgatcagccgattaacgcgaagctgatcgtggaattaggcgttgccgtggagattgtgcgtgatgaagatggcaacattcaccgcggcgaaattgccgaaaccgttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1074 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMQIMLMCTSRTIEAKYLDYCTELSNWKVVPVGPPFQDPITNDADDKELIDWLGTKDENSTVYVAFGSEYFLSREDMEEVAFGLELSNVNFIWVARFPKGEEQNLEDVLPKGFLERVGERGRVLDHFAPQPRILNHPSTGGFISHCGWNSVLESIDFGVPIIAMPMQNDQPINAKLIVELGVAVEIVRDEDGNIHRGEIAETVKDVITGETGEILRGKVRDISKNLKSIREEEMNAAAEELIQLCRNSNKYK

SEQ ID NO: 1075 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagcggccgggtgtagaatttccgtttccggcgatcaacctgccgaaggtggaacaggtgaagatgcgcgagatgtttgaaaaggagccggatgaagaagatcgcttagcagagggcaatatgggtatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1076 - protein, 451 aa, Artificial Sequence
  ADP-Glycosyltransferase Variant of SEQ ID NO: 954
MHHHHHHGGSGATLRVLMFPWLALGHINPFLSIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAEGNMGIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 1077 - DNA, 1353 bp, Artificial Sequence
  ADP-Glycosyltransferase Variant of SEQ ID NO: 954
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcgttatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttaccggaaggcaatatgcagatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttggcgtggagattgtgcgtgatgaagatggcaacattcaccgcggcgaaattgccgaaaccgttagagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 1078 - protein, 451 aa, Artificial Sequence
  ADP-Glycosyltransferase Variant of SEQ ID NO: 954
MHHHHHHGGSGATLRVLMFPWLAEGHINPFLNIAKQLADRGFLIYLCSTLINLESVIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLPEGNMQIMLMCTSRTIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERIGERGRVLDHFAPQQRILNHPSTGGFISHCGWNSVLESIDFGVPIIAMPMQNDQPINAKLIVELGVGVEIVRDEDGNIHRGEIAETVRDVMTGETGEILRGKVRDISKNLKSIREEEMNAAAEELIQLCRNSNKYK

SEQ ID NO: 1079 - DNA, 2379 bp, Artificial Sequence
  Sucrose Synthase Variant of SEQ ID NO: 74
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1080 - protein, 793 aa, Artificial Sequence
  Sucrose Synthase Variant of SEQ ID NO: 74
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1081 - DNA, 2379 bp, Artificial Sequence
  Sucrose Synthase Variant of SEQ ID NO: 74
atgattgaagaactgcgccaacagctgctggatgatccgcgttcatggtacgcattcctgcgtcatttagtcgcatctcagcgtgactcatggttatatacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgttggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1082 - protein, 793 aa, Artificial Sequence
  Sucrose Synthase Variant of SEQ ID NO: 74
MIEELRQQLLDDPRSWYAFLRHLVASQRDSWLYTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1083 - DNA, 2379 bp, Artificial Sequence
  Sucrose Synthase Variant of SEQ ID NO: 74
atgattgaagaactgcgccaacagctgctggatgatccgcgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggccaagttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1084 - protein, 793 aa, Artificial Sequence
  Sucrose Synthase Variant of SEQ ID NO: 74
MIEELRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGQVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1085 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtctccggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1086 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVSGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1087 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatcctgcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgacgtaccgatggag

SEQ ID NO: 1088 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEILRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHDVPME

SEQ ID NO: 1089 - DNA, 2379 bp, Artificial Sequence
  Sucrose Synthase Variant of SEQ ID NO: 74
atgattgaagcactgcgcacgcagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctacatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1090 - protein, 793 aa, Artificial Sequence
  Sucrose Synthase Variant of SEQ ID NO: 74
MIEALRTQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1091 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaatatccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1092 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAAREYPKYWLEISDAALARVAERYTWERYAERLMTIARIFGFWRFVLDRESQVMERYLQMFRHLQWRPLAHAVPME

SEQ ID NO: 1093 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatcgagcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1094 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIERMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1095 - DNA, 2379 bp, Artificial Sequence
  Sucrose Synthase Variant of SEQ ID NO: 74
atgattgaagaactgcgccaacagacactggatgatccgcgttcatggtacgcattcctgcgtcatttagtcgcatctcagcgtgactcatggttatatacggatttacagcgcgcgtgcgcggattttcgcgaacagctgccggaaggctatgctgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgttggtgccgagaatgtgcacattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1096 - protein, 793 aa, Artificial Sequence
  Sucrose Synthase Variant of SEQ ID NO: 74
MIEELRQQTLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVHILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1097 - DNA, 2379 bp, Artificial Sequence
  Sucrose Synthase Variant of SEQ ID NO: 74
atgattgaagaactgcgccaacagctgctggatgatccgcgttcatggtacgcattcctgcgtcatttagtcgcatctcagcgtgactcatggttatatacggatttacagcgcgcgtgcgcggattttcgcgaacagctgccggaaggctatgctgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtttctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1098 - protein, 793 aa, Artificial Sequence
  Sucrose Synthase Variant of SEQ ID NO: 74
MIEELRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1099 - DNA, 2379 bp, Artificial Sequence
  Sucrose Synthase Variant of SEQ ID NO: 74
atgattgaagaactgcgccaacagctgctggatgatcggcgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggccaagttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgttggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtttctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1100 - protein, 793 aa, Artificial Sequence
  Sucrose Synthase Variant of SEQ ID NO: 74
MIEELRQQLLDDRRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGQVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1101 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcatcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1102 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRHRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1103 - DNA, 2379 bp, Artificial Sequence
  Sucrose Synthase Variant of SEQ ID NO: 74
atgattgaagaactgcgccaacagctgctggatgatcggcgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatatatgtgcgcattcatcgtgaacagctggccctggaggagctgagcactgatgcctatctgcaagccaaagaaggccaagttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1104 - protein, 793 aa, Artificial Sequence
  Sucrose Synthase Variant of SEQ ID NO: 74
MIEELRQQLLDDRRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGQVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1105 - DNA, 2379 bp, Artificial Sequence
  Sucrose Synthase Variant of SEQ ID NO: 74
atgattgaagaactgcgccaacagctgctggatgatcggcgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1106 - protein, 793 aa, Artificial Sequence
  Sucrose Synthase Variant of SEQ ID NO: 74
MIEELRQQLLDDRRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1107 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttaaggaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1108 - protein, 793 aa, Artificial Sequence
  Sucrose Synthase Variant of SEQ ID NO: 74
MIEALRQQLLDDPRSWYAFLRHLVASQRDSWLYTDLQRACADFKEQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1109 - DNA, 2379 bp, Artificial Sequence
  Sucrose Synthase Variant of SEQ ID NO: 74
atgattgaagaactgcgccaacagctgctggatgatcggcgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggccaagttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgttggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1110 - protein, 793 aa, Artificial Sequence
  Sucrose Synthase Variant of SEQ ID NO: 74
MIEELRQQLLDDRRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGQVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1111 - DNA, 2379 bp, Artificial Sequence
  Sucrose Synthase Variant of SEQ ID NO: 74
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggccaagttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagatccgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgttggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtttctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1112 - protein, 793 aa, Artificial Sequence
  Sucrose Synthase Variant of SEQ ID NO: 74
MIEELRQQLLDDPRSWYAFLRHLVASQRDSWLQTDLQRACADFREQLPEGYAEGIGPLEDFVAHTQEVIFRDPWMVFAWRPRPGRWIYVRIHREQLALEELSTDAYLQAKEGQVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1113 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcctgagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1114 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGLSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1115 - DNA, 2379 bp, Artificial Sequence
  Sucrose Synthase Variant of SEQ ID NO: 74
atgattgaagcactgcgccaaatgctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1116 - protein, 793 aa, Artificial Sequence
  Sucrose Synthase Variant of SEQ ID NO: 74
MIEALRQMLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1117 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttagatgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggactgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1118 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLDAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWTDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1119 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggacggatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1120 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWTDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1121 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaggccgtaccgatggag

SEQ ID NO: 1122 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1123 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgacacggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1124 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDTEIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1125 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaagtggaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1126 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEVEEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1127 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatcactcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1128 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEITRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1129 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaaagtctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1130 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHRESLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1131 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgcggctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1132 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSRLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1133 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaaaaggaccatcactttgcatgtcagtttaccgcggatctgatcgcgatgaatgcagcagacatcatcgtgacgagtacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1134 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEKDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1135 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcctgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1136 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1137 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1138 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDVEIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1139 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatctgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1140 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEICRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1141 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgactctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1142 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSTLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1143 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaaactgaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1144 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHETDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1145 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagcagtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1146 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1147 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1148 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1149 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatcgtgcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1150 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIVRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1151 - DNA, 2379 bp, Artificial Sequence
  Sucrose Synthase Variant of SEQ ID NO: 74
atgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtgcgcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1152 - protein, 793 aa, Artificial Sequence
  Sucrose Synthase Variant of SEQ ID NO: 74
MIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRARGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1153 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagcagccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacaatatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggccggatcatgaaaccgaccatcactttgcatgtcagtttaccgcggatctgatcgcgatgaatgcagcagacatcatcgtgacgagcacataccaggaaattgcaggtaatgacacagagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgagcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1154 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWPDHETDHHFACQFTADLIAMNAADIIVTSTYQEIAGNDTEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVSNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1155 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtcgttggatttatgtgcgcattcatagagaacagctggccctggaggagctgagcactgatgcctatctgcaagccaaagaaggcatcgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgacgcgccgagcccagctgccctggagagcttcctggatcgcatcccgatgattagccgcatcctgatcgtgagcatacacggatggtttgcgcaggacaaggttctgggtcgtccggacactggtggtcaggtcgtgtatattctggatcaggcccgtgcactggaacgcgaaatgcgtaaccgcctgcgccaacagggtgttgatgttgagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgattcgaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtggttatcggtggtcatattgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1156 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEAIFRDPWMVFAWRPRPGRWIYVRIHREQLALEELSTDAYLQAKEGIVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDAPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVVIGGHIDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1157 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1158 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1159 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgacgcgccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1160 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEAIFRDPWMVFAWRPRPGRWIYVRIHREQLALEELSTDAYLQAKEGIVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDAPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1161 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtgggtggtttttgcgtggcgtccacgtccaggtcgttggatttatgtgcgcattcatcgtgaacagctggccctggaggagctgagcactgatgaatatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcatttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagtttcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatggttagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccacgcattttgattgcgacccgtttaatcccggaaagtgatggcacgacttgtgaccagcgtctggagcctgtccatggtaccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagattatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1162 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWVVFAWRPRPGRWIYVRIHREQLALEELSTDEYLQAKEGIVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFAPGWGNTAGRVRETMRLLMDLLDSPSPAALESFLDRIPMVSRILIVSIHGWFAQDKVLGRPDTGGQVVYILDQARALEREMRNRLRQQGVDVEPRILIATRLIPESDGTTCDQRLEPVHGTENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1163 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtctgcgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaagattaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1164 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1165 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtctggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagcttctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1166 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGVWIYVRIHREQLALEELSTDAYLQAKEGIVGLGAEGEAVLTVDFRDFRPVSRRLRDESTIGDGLTHLNRRLAGRIFSDLAAGRSQLLEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1167 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaatcactggccctggaggagctgagcactgatgcctatctgcaagccaaagaaggcatcgttggcttaggtgcagaaggtgaagcagttctgacggtggatttccgcgattttcgtccggttagccgccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggagggatcatgaaaccgaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgagcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcacgccgtaccgtcggag

SEQ ID NO: 1168 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHRESLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHETDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVSNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPSE

SEQ ID NO: 1169 - DNA, 2379 bp, Artificial Sequence
  Sucrose Synthase Variant of SEQ ID NO: 1080
atgattgaagaactgcgccagcagctgctggatgatccgcgttcatggtacgcattcctgcgtcatttagtcgcatctcagcgtgactcatggttacagacggatttacagcgcgcgtgcgcggattttagagaacagcttccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcatcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccacggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacggccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1170 - protein, 793 aa, Artificial Sequence
  Sucrose Synthase Variant of SEQ ID NO: 1080
MIEELRQQLLDDPRSWYAFLRHLVASQRDSWLQTDLQRACADFREQLPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRHRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1171 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttgggagtatgtgcgcattcatcgtgaacagctggccctggaggagctgagcactgatgcctatctgcaagccaaagaaggcatcgttggcttaggtgcagaaggtgaagcagttctggaagtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcgacaccgcgggccgtgttcgcgaaaccatgcgtctgctgatggatctgcttgactctccgagcccagctgccctggagagcttcctggatcgcatcccgatgattagccgcgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtaccttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagactttatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggggcagatcgtcgtggtgttctcgaagatcgccagaaaccgctgctgctgtcgatggcccgtatggatcgcatcaagaacctgagcggtctggccgaactgtatggtcgtagctctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcggccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1172 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWEYVRIHREQLALEELSTDAYLQAKEGIVGLGAEGEAVLEVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGDTAGRVRETMRLLMDLLDSPSPAALESFLDRIPMISRVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSERLGVTQCNIAHALEKSKYLYSDLHWRDHEQDHHFACQFTADLIAMNAADFIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEAAAERLADFLEAARERPKYWLEISDAALARVAERYTWERYAERLMTIARIFGFWRFVLDRESQVMERYLQMFRHLQWRPLAHAVPME

SEQ ID NO: 1173 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgagcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggccggatcatgaaaccgaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaagccgtaccgatggag

SEQ ID NO: 1174 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWPDHETDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAEAVPME

SEQ ID NO: 1175 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaatcactggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacaatatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgacacagagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1176 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHRESLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDTEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAHAVPME

SEQ ID NO: 1177 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtctgcgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaagattaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1178 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1179 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagcagccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggacggatcatgaaaccgaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaagccgtaccgatggag

SEQ ID NO: 1180 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWTDHETDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1181 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggacggatcatgaacaggaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcacgccgtaccgatggag

SEQ ID NO: 1182 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWTDHEQDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1183 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagcgaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcggcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgctgaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggattatactttaccgggcttgtatcgtgtcgagaatggtattgacgtgttcgatagcaagtttaacattgtgagtccgggcgcagatccacgcttttattttagctatgcacgtactgaagaacgcccaagctctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggcggaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatccctacgaccatgaagcgaccgcagaacgtctggccgacttcctggaagcagcgcgtgaacgtccgaaatattggcttgaaattagcgatgcggctcttgcgcgcgttgcggaacgttacacgtgggagcgctatgcggaacgcttgatgaccatcgcgcgtatcttcggcttttggcgcttcgttctggatcgcgaatcacaggtcatggaacgctatctggaaatgttccgccacctgcaatggcgcccgctggctcatgccgtaccgatggag

SEQ ID NO: 1184 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMLNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPYDHEATAERLADFLEAARERPKYWLEISDAALARVAERYTWERYAERLMTIARIFGFWRFVLDRESQVMERYLEMFRHLQWRPLAHAVPME

SEQ ID NO: 1185 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagcagccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacaatatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgggatcatgaaaccgaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaagccgtaccgtcggag

SEQ ID NO: 1186 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHETDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPSE

SEQ ID NO: 1187 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatctttcgtgatccgtggatggtttttgcgtggcgtccacgtccaggtcgttggatttatgtgcgcattcatcgtgaacagctggccgtggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaacaccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccggacccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatcttcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1188 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLAVEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPDPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1189 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaatcactggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggacggatcatgaacaggaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgagtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaagccgtaccgtcggag

SEQ ID NO: 1190 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHRESLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWTDHEQDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAEAVPSE

SEQ ID NO: 1191 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaatcactggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtagaatatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgggatcatgaacaggaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaagccgtaccgatggag

SEQ ID NO: 1192 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHRESLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVEYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAEAVPME

SEQ ID NO: 1193 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatgtggaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcatacacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaataagcgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgattatcggtggtcatgttgatgtgggcaatagtcgcgatgcagaagaacgcgaagaaatccgtcgtatgcacgagatcatggaccattaccagctggatggtcagctgcgttgggtgggatcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1194 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHVEQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNKREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1195 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtgggtggtttttgcgtggcgtccacgtccaggtcgttggatttatgtgcgcattcatcgtgaacagctggccctggaggagctgagcactgatgaatatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtaccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaagcctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggccaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagattatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgttggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacgggtcatggaacgctatctgcaaatgttccgccacctgcaatggcgcccgctggctcatgccgtaccgatggag

SEQ ID NO: 1196 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWVVFAWRPRPGRWIYVRIHREQLALEELSTDEYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGTENVQILRVPFRYPDGRIHPHWISRFKIWPWLERYAQDLEREVLAELGSRPDLIIGNYSDGNLVASLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESRVMERYLQMFRHLQWRPLAHAVPME

SEQ ID NO: 1197 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtgggtggtttttgcgtggcgtccacgtccaggtcgttggatttatgtgcgcattcatcgtgaacagctggccctggaggagctgagcactgatgaatatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcctgtcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagattatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1198 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWVVFAWRPRPGRWIYVRIHREQLALEELSTDEYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERLSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1199 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtgggtggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtaccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggccaccaggactatactttaccgggcttgtatcgtgtcgagaatggtattgacgtgttcgatagcaagtttaacattgtgagtccgggcgcagatccacgcttttattttagctatgcacgtactgaagaacgcctgtcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgttggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1200 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWVVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGTENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERLSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1201 - DNA, 2379 bp, Artificial Sequence
  Sucrose Synthase Variant of SEQ ID NO: 1080
atgattgaagaactgcgccagatgctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcatcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1202 - protein, 793 aa, Artificial Sequence
  Sucrose Synthase Variant of SEQ ID NO: 1080
MIEELRQMLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRHRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1203 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcaccgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcattacgagcacataccaggaaattgcaggtaatgaccgcgagatcggtcaatatgaaggtcaccaggactatactttaccgggcttgtatcgtgtcgagaacggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcttagaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1204 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIITSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1205 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaatcactggccctggaggagctgagcactgatgcctatctgcaagccaaagaaggcatcgttggcttaggtgcagaaggtgaagcagttctgacggtggatttccgcgattttcgtccggttagcagccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacaatatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggagggatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaagccgtaccgatggag

SEQ ID NO: 1206 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHRESLALEELSTDAYLQAKEGIVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1207 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagcgaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcggaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcacagctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcattgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1208 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGAQLDKTVAGELYRVVADGRGVFVQPALFEAFGLTVIEAMSSGLPVFATRFGGPLEIIEDGVSGFHIDPNDHEATAERLADFLEAARERPKYWLEISDAALARIAERYTWERYAERLMTIARIFGFWRFVLDRESQVMERYLQMFRHLQWRPLAHAVPME

SEQ ID NO: 1209 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatgtggaacagctggccctggaggagctgagcactgatgcctatctgcaagccaaagaaggcatcgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcatacacggatggtttgcgcaggacaaggttctgggtcgtccggacactggtggtcaggtcgtgtatattctggatcaggcccgtgcactggaacgcgaaatgcgtaaccgcctgcgccaacagggtgttgatgttgagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatccgaagtttaacattgtgagtccgggcgcagatccacgcttttattttagctatgcacgtactgaagaacgcccatcgtctctggagccagaaatcgaaagtctgctgtttggccgcgaaccaggtgcagatcatcgtggtgttctcgaagatcgccagaaaccgctgctgctgtcgatggcccgtatggatcgcatcaagaacctgagcggtctggccgaactgtatggtcgtagttctcgcttacgtggtctggccaatttggtggttatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcatgccgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1210 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHVEQLALEELSTDAYLQAKEGIVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDPKFNIVSPGADPRFYFSYARTEERPSSLEPEIESLLFGREPGADHRGVLEDRQKPLLLSMARMDRIKNLSGLAELYGRSSRLRGLANLVVIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEACRERPKYWLEISDAALARVAERYTWERYAERLMTIARVFGFWRFVLDRESQVMERYLQMFRHLQWRPLAHAVPME

SEQ ID NO: 1211 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgacggtcttacccatctgaatcgtcgtttagcaggtcgcatctttagcgatttagcagcaggtcgtagtcagatcctggaatttctgagcctgcatcgtctggatggtcagaatctgatgctgagcaaccgtaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcctacacggatggtttgcgcaggacaaggttctgggtcgtccggacactggtggtcaggtcgtgtatattctggatcaggcccgtgcactggaacgcgaaatgcgtaaccgcctgcgccaacagggtgttgatattgagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaataagcgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcatgccgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1212 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEAIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNRNTDFDSLRQTVQYLGTLPRETPWAEIREDMRRRGFAPGWGNTAGRVRETMRLLMDLLDSPSPAALESFLDRIPMISRILIVSLHGWFAQDKVLGRPDTGGQVVYILDQARALEREMRNRLRQQGVDIEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNKREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEACRERPKYWLEISDAALARVAERYTWERYAERLMTIARVFGFWRFVLDRESQVMERYLQMFRHLQWRPLAHAVPME

SEQ ID NO: 1213 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacgctggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtctggatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaaaggtatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgttacgagcacataccaggaaattgcaggtaatgaccgcgagatcggtcaatatgaaggtcaccaggactatactttaccgggcttgtatcgtgtcgagcacggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagaacgtcgtggtgttctcgaagatcgccagaaaccgctgctgctgtcgatggcccgtatggatcgcatcaagaacctgagcggtctggccgaactgtatggtcgtagttctcgcttacgtgaactggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagttgcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgggtatcttcggcttttggcgcttcgttctggatcgcgaatcacaggtcatggaacgctatctgcaaatgttccgccacctgcaatggcgcccgctggctcatgccgtaccgatggag

SEQ ID NO: 1214 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGIVGLGAEGEAVLTLDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGLDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVEHGIDVFDSKFNIVSPGADPRFYFSYARTEERPSSLEPEIESLLFGREPGAERRGVLEDRQKPLLLSMARMDRIKNLSGLAELYGRSSRLRELANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIAGIFGFWRFVLDRESQVMERYLQMFRHLQWRPLAHAVPME

SEQ ID NO: 1215 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaatcactggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggagggatcatgaaaccgaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaagccgtaccgatggag

SEQ ID NO: 1216 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHRESLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHETDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAEAVPME

SEQ ID NO: 1217 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttggatttatgtgcgcattcatcgtgaatcactggccctggaggagctgagcactgatgcctatctgcaagccaaagaaggcatcgttggcttaggtgcagaaggtgaagcagttctgacggtggatttccgcgattttcgtccggttagccgccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaactcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgacgtggagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaagccgtaccgatggag

SEQ ID NO: 1218 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEVIFRDPWMVFAWRPRPGRWIYVRIHRESLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLELEVLAELGSRPDLIIGNYSDGNLVATLLSERLGVTQCNIAHALEKSKYLYSDLHWRDHEQDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1219 - DNA, 2379 bp, Artificial Sequence
  Sucrose Synthase Variant of SEQ ID NO: 1080
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtaacggtcttacccatctgaatcgtcgtttagcaggtcgcatctttagcgatttagcagcaggtcgtagtcagatcctggaatttctgagcctgcatcgtctggatggtcagaatctgatgctgagcaacggtaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgacgcgccgagcccagctgccctggagagcttcctggatcgcatcccgatgattagccgcatcctgatcgtgagcatacacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaaattctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatccgaagtttaacattgtgagtccgggcgcagatccacgcttttattttagctatgcacgtactgaagaacgcccatcgtctctggagccagaaatcgaaagtctgctgtttggccgcgaaccaggtgcagatcatcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgattatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgacaatcgcgcgtattttcggcttttggcgcttcgttctggatcgcgaatcacaggtcatggaacgctatctgcaaatgttccgccacctgcaatggcgcccgctggctcatgccgtaccgatggag

SEQ ID NO: 1220 - protein, 793 aa, Artificial Sequence
  Sucrose Synthase Variant of SEQ ID NO: 1080
MIEELRQQLLDDPRSWYAFLRHLVASQRDSWLQTDLQRACADFREQHPEGYDEGIGPLEDFVAHTQEAIFRDPWMVFAWRPRPGRWIYVRIHREQLALEELSTDAYLQAKEGIVGLGAEGEAVLTVDFRDFRPVSRRLRDESTIGNGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDAPSPAALESFLDRIPMISRILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREILAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDPKFNIVSPGADPRFYFSYARTEERPSSLEPEIESLLFGREPGADHRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1221 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1222 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1223 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttggatatatgtgcgcattcatcgtgaacagctggccctggaggagctgagcactgatgcctatctgcaagccaaagaaggccttgttggcttaggtgcagaaggtgaagcagttctggaagtggatttcagggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacaatatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1224 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWMVFAWRPRPGVWIYVRIHREQLALEELSTDAYLQAKEGLVGLGAEGEAVLEVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1225 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcatttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcggaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1226 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDAYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1227 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgcctatctgcaagccaaagaaggccttgttggcttaggtgcagaaggtgaagcagttctgacggtggatttcgaggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtaccttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1228 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDAYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1229 - DNA, 2379 bp, Artificial Sequence
  Sucrose Synthase Variant of SEQ ID NO: 1158
atgattgaagaactgcgccaacaactgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtaggtggatttatgtgcgcattcatgttgaacagctggccgtggaggagctgagcactgatgcctatctgcaagccaaagaaggccttgttggcttaggtgcagaaggtgaagcagttctgacggtggatttccgcgattttcgtccggttagcagccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgacgcgccggatccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaagaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcacccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcacgccgtaccgatggag

SEQ ID NO: 1230 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEAIFRDPWMVFAWRPRPGRWIYVRIHVEQLAVEELSTDAYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDAPDPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAHAVPME

SEQ ID NO: 1231 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctggaagtggatttcagggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacattctgatcgtgagcattcacggatggtttgcgcaggacaaggttctgggtcgtccggacactggtggtcaggtcgtgtatattctggatcaggcccgtgcactggaacgcgaaatgcggaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtattttcggcttttggcgcttcgttctggatcgcgaatcacaggtcatggaacgctatctgcaaatgttccgccacctgcaatggcgcccgctggctcatgccgtaccgatggag

SEQ ID NO: 1232 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDEYLQAKEGLVGLGAEGEAVLEVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1233 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggccttgttggcttaggtgcagaaggtgaagcagttctgacggtggatttcgaggattttcgtccggttagccgtcgtttacgcgacgagagcaccattggtgatggtcttacccatctgaatcgtcgtttagcaggtcgcatctttagcgatttagcagcaggtcgtagtcagcttctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1234 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWMVFAWRPRPGRWIYVRIHREQLALEELSTDAYLQAKEGLVGLGAEGEAVLTVDFEDFRPVSRRLRDESTIGDGLTHLNRRLAGRIFSDLAAGRSQLLEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1235 - DNA, 2379 bp, Artificial Sequence
  Sucrose Synthase Variant of SEQ ID NO: 1158
atgattgaagaactgcgccaaatgctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggccttgttggcttaggtgcagaaggtgaagcagttctgacggtggatttccgcgattttcgtccggttagcagccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgacgcgccgtccccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcctgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgacgttgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaagtattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaggccgtaccgatggag

SEQ ID NO: 1236 - protein, 793 aa, Artificial Sequence
  Sucrose Synthase Variant of SEQ ID NO: 1158
MIEELRQMLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDAPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDVEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1237 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttggatatatgtgcgcattcatcgtgaacagctggccctggaggagctgagcactgatgaatatctgcaagccaaagaaggccttgttggcttaggtgcagaaggtgaagcagttctgacggtggatttcgaggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtagaatatctgggcaccttaccacgtgaaactccgtgggcagagattcgtgaagacatgcgtcgtcgtggttttgaaccaggttggggcgacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcggaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1238 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWMVFAWRPRPGVWIYVRIHREQLALEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVEYLGTLPRETPWAEIREDMRRRGFEPGWGDTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1239 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtgggtggtttttgcgtggcgtccacgtccaggtgtttggatatatgtgcgcattcatcgtgaacagctggccctggaggagctgagcactgatgaatatctgcaagccaaagaaggccttgttggcttaggtgcagaaggtgaagcagttctggaagtggatttcgaggattttcgtccggttagccgtcgtttacgcgacgagagcaccattggtgatggtcttacccatctgaatcgtcgtttagcaggtcgcatctttagcgatttagcagcaggtcgtagtcagcttctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtattttcggcttttggcgcttcgttctggatcgcgaatcacaggtcatggaacgctatctgcaaatgttccgccacctgcaatggcgcccgctggctcatgccgtaccgatggag

SEQ ID NO: 1240 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWVVFAWRPRPGVWIYVRIHREQLALEELSTDEYLQAKEGLVGLGAEGEAVLEVDFEDFRPVSRRLRDESTIGDGLTHLNRRLAGRIFSDLAAGRSQLLEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1241 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtgggtggtttttgcgtggcgtccacgtccaggtgtttggatatatgtgcgcattcatcgtgaacagctggccctggaggagctgagcactgatgcctatctgcaagccaaagaaggccttgttggcttaggtgcagaaggtgaagcagttctgacggtggatttcgaggattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatggttagcaacattctgatcgtgagcattcacggatggtttgcgcaggacaaggttctgggtcgtccggacactggtggtcaggtcgtgtatattctggatcaggcccgtgcactggaacgcgaaatgcggaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtaccttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtattttcggcttttggcgcttcgttctggatcgcgaatcacaggtcatggaacgctatctgcaaatgttccgccacctgcaatggcgcccgctggctcatgccgtaccgatggag

SEQ ID NO: 1242 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWVVFAWRPRPGVWIYVRIHREQLALEELSTDAYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMVSNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1243 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttgggaatatgtgcgcattcatcgtgaacagctggccctggaggagctgagcactgatgcctatctgcaagccaaagaaggccttgttggcttaggtgcagaaggtgaagcagttctggaagtggatttcgaggattttcgtccggttagccgtcgtttacgcgacgagagcaccattggtgatggtcttacccatctgaatcgtcgtttagcaggtcgcatctttagcgatttagcagcaggtcgtagtcagcttctggaatttctgagcctgcatcgtctggatggtcagaatctgatgctgagcaacggcaataccgattttgactctttacgtcaaaccgtacaatatctgggcaccttaccacgtgaaactccgtgggcagagattcgtgaagacatgcgtcgtcgtggttttgaaccaggttggggcgacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctacaatggcgcccgctggctcatgccgtaccgatggag

SEQ ID NO: 1244 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGRWEYVRIHREQLALEELSTDAYLQAKEGLVGLGAEGEAVLEVDFEDFRPVSRRLRDESTIGDGLTHLNRRLAGRIFSDLAAGRSQLLEFLSLHRLDGQNLMLSNGNTDFDSLRQTVQYLGTLPRETPWAEIREDMRRRGFEPGWGDTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1245 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtgggtggtttttgcgtggcgtccacgtccaggtgtttggatatatgtgcgcattcatcgtgaacagctggccctggaggagctgagcactgatgcctatctgcaagccaaagaaggccttgttggcttaggtgcagaaggtgaagcagttctgacggtggatttcagggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatggttagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaagattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtattttcggcttttggcgcttcgttctggatcgcgaatcacaggtcatggaacgctatctgcaaatgttccgccacctgcaatggcgcccgctggctcatgccgtaccgatggag

SEQ ID NO: 1246 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWVVFAWRPRPGVWIYVRIHREQLALEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMVSNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1247 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttggatatatgtgcgcattcatcgtgaacagctggccctggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagcttctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1248 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWMVFAWRPRPGVWIYVRIHREQLALEELSTDAYLQAKEGLVGLGAEGEAVLTVDFRDFRPVSRRLRDESTIGDGLTHLNRRLAGRIFSDLAAGRSQLLEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1249 - DNA, 2379 bp, Artificial Sequence
  Sucrose Synthase Variant of SEQ ID NO: 1158
atgattgaagaactgcgccaaatgctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaatcactggccgtggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcctgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaagaccatcactttgcgtgtcagtttaccgcggatctgatcgcgatgaatgcagcagacatcatcgtgacgagcacataccaggaaattgcaggtaatgacgttgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcacccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgattatcggtggtcatattgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaagtattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaggccgtaccgatggag

SEQ ID NO: 1250 - protein, 793 aa, Artificial Sequence
  Sucrose Synthase Variant of SEQ ID NO: 1158
MIEELRQMLLDDPRSWYAFLRHLVASQRDSWLQTDLQRACADFREQHPEGYDEGIGPLEDFVAHTQEVIFRDPWMVFAWRPRPGRWIYVRIHRESLAVEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDVEIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHIDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1251 - DNA, 2379 bp, Artificial Sequence
  Sucrose Synthase Variant of SEQ ID NO: 1158
atgattgaagaactgcgccaaatgctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtaggtggatttatgtgcgcattcatcgtgaacagctggccgtggaggagctgagcactgatgcctatctgcaagccaaagaaggccttgttggcttaggtgcagaaggtgaagcagttctgacggtggatttccgcgattttcgtccggttagccgccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcatcgtggttttgaaccaggttggggcaacaccgcgggccgtgttcgcgaaaccatgcgtctgctgatggatctgcttgacgcgccggatccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcctgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaagaccatcactttgcgtgtcagtttaccgcggatctgatcgcgatgaatgcagcagacatcatcgtgacgagcacataccaggaaattgcaggtaataagagagagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcacccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtggttatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1252 - protein, 793 aa, Artificial Sequence
  Sucrose Synthase Variant of SEQ ID NO: 1158
MIEELRQMLLDDPRSWYAFLRHLVASQRDSWLQTDLQRACADFREQHPEGYDEGIGPLEDFVAHTQEAIFRDPWMVFAWRPRPGRWIYVRIHREQLAVEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRHRGFEPGWGNTAGRVRETMRLLMDLLDAPDPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNKREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVVIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAHAVPME

SEQ ID NO: 1253 - DNA, 2379 bp, Artificial Sequence
  Sucrose Synthase Variant of SEQ ID NO: 1158
atgattgaagaactgcgccaaatgctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtaggtggatttatgtgcgcattcatcgtgaatcactggccgtggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgacacagagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtggttatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcacgccgtaccgagcgag

SEQ ID NO: 1254 - protein, 793 aa, Artificial Sequence
  Sucrose Synthase Variant of SEQ ID NO: 1158
MIEELRQMLLDDPRSWYAFLRHLVASQRDSWLQTDLQRACADFREQHPEGYDEGIGPLEDFVAHTQEAIFRDPWMVFAWRPRPGRWIYVRIHRESLAVEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDTEIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVVIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAHAVPSE

SEQ ID NO: 1255 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaatcactggccctggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaaactgaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaggccgtaccgatggag

SEQ ID NO: 1256 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGRWIYVRIHRESLALEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWPDHETDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAEAVPME

SEQ ID NO: 1257 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtcgttgggaatatgtgcgcattcatcgtgaacagctggccctggaggagctgagcactgatgcatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgctgaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtaccttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1258 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGRWEYVRIHREQLALEELSTDAYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMLNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1259 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggccttgttggcttaggtgcagaaggtgaagcagttctgacggtggatttcagggattttcgtccggttagccgtcgtttacgcgacgagagcaccattggtgatggtcttacccatctgaatcgtcgtttagcaggtcgcatctttagcgatttagcagcaggtcgtagtcagcttctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatggttagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacattatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtattttcggcttttggcgcttcgttctggatcgcgaatcacaggtcatggaacgctatctgcaaatgttccgccacctgcaatggcgcccgctggctcatgccgtaccgatggag

SEQ ID NO: 1260 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGLVGLGAEGEAVLTVDFRDFRPVSRRLRDESTIGDGLTHLNRRLAGRIFSDLAAGRSQLLEFLSLHRLDGQNLMLSNGNTDFDSLRQTVQYLGTLPRETPWAEIREDMRRRGFEPGWGNTAGRVRETMRLLMDLLDSPSPAALESFLDRIPMVSNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1261 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtgggtggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttcagggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatggttagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcggccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1262 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWVVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMVSNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEAAAERLADFLEAARERPKYWLEISDAALARVAERYTWERYAERLMTIARIFGFWRFVLDRESQVMERYLQMFRHLQWRPLAHAVPME

SEQ ID NO: 1263 - DNA, 2379 bp, Artificial Sequence
  Sucrose Synthase Variant of SEQ ID NO: 1158
atgattgaagaactgcgccaaatgctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatgttgaatcactggccgtggaggagctgagcactgatgcctatctgcaagccaaagaaggccttgttggcttaggtgcagaaggtgaagcagttctgacggtggatttccgcgattttcgtccggttagcagccgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcatcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcctgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtggttatcggtggtcatattgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaagtattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaggccgtaccgatggag

SEQ ID NO: 1264 - protein, 793 aa, Artificial Sequence
  Sucrose Synthase Variant of SEQ ID NO: 1158
MIEELRQMLLDDPRSWYAFLRHLVASQRDSWLQTDLQRACADFREQHPEGYDEGIGPLEDFVAHTQEVIFRDPWMVFAWRPRPGRWIYVRIHVESLAVEELSTDAYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEIREDMRHRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVVIGGHIDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1265 - DNA, 2379 bp, Artificial Sequence
  Sucrose Synthase Variant of SEQ ID NO: 1158
atgattgaagaactgcgccaacaactgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtaggtggatttatgtgcgcattcatgttgaatcactggccctggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggacggatcatgaaactgaccatcactttgcgtgtcagtttaccgcggatctgatcgcgatgaatgcagcagacatcatcgtgacgagcacataccaggaaattgcaggtaatgacgttgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcacccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtggttatcggtggtcatgttgatgtgagcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaagtattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggag

SEQ ID NO: 1266 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEAIFRDPWMVFAWRPRPGRWIYVRIHVESLALEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSEKLGVTQCNIAHALEKSKYLYSDLHWTDHETDHHFACQFTADLIAMNAADIIVTSTYQEIAGNDVEIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVVIGGHVDVSNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 1267 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggccttgttggcttaggtgcagaaggtgaagcagttctgacggtggatttcagggattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcggaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtaccttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcggccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1268 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWMVFAWRPRPGRWIYVRIHREQLALEELSTDAYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEAAAERLADFLEAARERPKYWLEISDAALARVAERYTWERYAERLMTIARVFGFWRFVLDRESQVMERYLQMFRHLQWRPLAHAVPME

SEQ ID NO: 1269 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtgggtggtttttgcgtggcgtccacgtccaggtgtttggatatatgtgcgcattcatcgtgaacagctggccctggaggagctgagcactgatgaatatctgcaagccaaagaaggccttgttggcttaggtgcagaaggtgaagcagttctgacggtggatttcagggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtaccttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1270 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWVVFAWRPRPGVWIYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1271 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggccttgttggcttaggtgcagaaggtgaagcagttctgacggtggatttcgaggattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacagtatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacattctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacattatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1272 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGRWIYVRIHREQLALEELSTDAYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1273 - DNA, 2379 bp, Artificial Sequence
  Sucrose Synthase Variant of SEQ ID NO: 1158
atgattgaagaactgcgccaacaactgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtaggtggatttatgtgcgcattcatgttgaatcactggccctggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaaactgaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaggccgtaccgatggag

SEQ ID NO: 1274 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEAIFRDPWMVFAWRPRPGRWIYVRIHVESLALEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHETDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1275 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtgggtggtttttgcgtggcgtccacgtccaggtgtttgggaatatgtgcgcattcatcgtgaacagctggccctggaggagctgagcactgatgcatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagcttctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1276 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWVVFAWRPRPGVWEYVRIHREQLALEELSTDAYLQAKEGLVGLGAEGEAVLTVDFRDFRPVSRRLRDESTIGDGLTHLNRRLAGRIFSDLAAGRSQLLEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1277 - DNA, 2379 bp, Artificial Sequence
  Sucrose Synthase Variant of SEQ ID NO: 1158
atgattgaagaactgcgccaaatgctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatgttgaatcactggccctggaggagctgagcactgatgcctatctgcaagccaaagaaggcattgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactcgccggatccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcctgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggacggatcatgaacaagaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtggttatcggtggtcatattgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcattattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaggccgtaccgatggag

SEQ ID NO: 1278 - protein, 793 aa, Artificial Sequence
  Sucrose Synthase Variant of SEQ ID NO: 1158
MIEELRQMLLDDPRSWYAFLRHLVASQRDSWLQTDLQRACADFREQHPEGYDEGIGPLEDFVAHTQEVIFRDPWMVFAWRPRPGRWIYVRIHVESLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPDPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWTDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVVIGGHIDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARIFGFWRFVLDRESQVMERYLQMFRHLQWRPLAEAVPME

SEQ ID NO: 1279 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtgggtggtttttgcgtggcgtccacgtccaggtgtttgggaatatgtgcgcattcatcgtgaacagctggccctggaggagctgagcactgatgcctatctgcaagccaaagaaggccttgttggcttaggtgcagaaggtgaagcagttctgacggtggatttcgaggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacaatatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtaccttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctggaaatgttccgccacctgcaatggcgcccgctggctcatgccgtaccgatggag

SEQ ID NO: 1280 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWVVFAWRPRPGVWEYVRIHREQLALEELSTDAYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLEMFRHLQWRPLAHAVPME

SEQ ID NO: 1281 - DNA, 2379 bp, Artificial Sequence
  Sucrose Synthase Variant of SEQ ID NO: 1158
atgattgaagaactgcgccaacaactgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtaggtggatttatgtgcgcattcatgttgaatcactggccgtggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcctgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaagaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcacccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaagtattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcacgccgtaccgagcgag

SEQ ID NO: 1282 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGRWIYVRIHVESLAVEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPSE

SEQ ID NO: 1283 - DNA, 2379 bp, Artificial Sequence
  Sucrose Synthase Variant of SEQ ID NO: 1158
atgattgaagaactgcgccaaatgctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtaggtggatttatgtgcgcattcatcgtgaacagctggccctggaggagctgagcactgatgcctatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctgaggccgtaccgatggag

SEQ ID NO: 1284 - protein, 793 aa, Artificial Sequence
  Sucrose Synthase Variant of SEQ ID NO: 1158
MIEELRQMLLDDPRSWYAFLRHLVASQRDSWLQTDLQRACADFREQHPEGYDEGIGPLEDFVAHTQEAIFRDPWMVFAWRPRPGRWIYVRIHREQLALEELSTDAYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAEAVPME

SEQ ID NO: 1285 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtaggtggatttatgtgcgcattcatcgtgaacagctggccctggaggagctgagcactgatgcctatctgcaagccaaagaaggccttgttggcttaggtgcagaaggtgaagcagttctggaagtggatttcgaggattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtaccttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1286 - protein, 793 aa, Artificial Sequence
  Sucrose Synthase Variant of SEQ ID NO: 1158
MIEELRQQLLDDPRSWYAFLRHLVASQRDSWLQTDLQRACADFREQLPEGYDEGIGPLEDFVAHTQEVIFRDPWMVFAWRPRPGRWIYVRIHREQLALEELSTDAYLQAKEGLVGLGAEGEAVLEVDFEDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1287 - DNA, 2379 bp, Artificial Sequence
  Sucrose Synthase Variant of SEQ ID NO: 1158
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttggatatatgtgcgcattcatcgtgaacagctggccctggaggagctgagcactgatgcctatctgcaagccaaagaaggccttgttggcttaggtgcagaaggtgaagcagttctggaagtggatttcagggattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacagtatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacatcctgatcgtgagcattcacggatggtttgcgcaggacaaggttctgggtcgtccggacactggtggtcaggtcgtgtatattctggatcaggcccgtgcactggaacgcgaaatgcggaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtaccttgaacgctatgcacaggatctggaacgcgaagttctggccgaattaggtagtcgtccagatctgatcatcggcaactatagcgacggtaatctggttgcaaccctgctgtcagaaagattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtattttcggcttttggcgcttcgttctggatcgcgaatcacaggtcatggaacgctatctggaaatgttccgccacctgcaatggcgcccgctggctcatgccgtaccgatggag

SEQ ID NO: 1288 - protein, 793 aa, Artificial Sequence
  Sucrose Synthase Variant of SEQ ID NO: 1158
MIEELRQQLLDDPRSWYAFLRHLVASQRDSWLQTDLQRACADFREQHPEGYDEGIGPLEDFVAHTQEVIFRDPWMVFAWRPRPGVWIYVRIHREQLALEELSTDAYLQAKEGLVGLGAEGEAVLEVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLEMFRHLQWRPLAHAVPME

SEQ ID NO: 1289 - DNA, 1371 bp, Artificial Sequence
  ADP-Glycosyltransferase Variant of SEQ ID NO: 32
atggagaacaaaaccgaaaccaccgtgcgtcgtcgtcgtatcattctgtttccggttccgttcccgggccacatcaacccgattctgcaactggcgaacgtgctgtacagcaagggttttagcatcaccatttttcacaccaacttcaacaagccgaaaaccagcaactatccgcacttcacctttcgtttcatcttggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagcttggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacggcgcgattggtgcgttctggacccacggcggttggaacggcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 1290 - protein, 457 aa, Artificial Sequence
  ADP-Glycosyltransferase Variant of SEQ ID NO: 32
MENKTETTVRRRRIILFPVPFPGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSQSEVDEKDFLEIARGLVDSKQSFLWRVRPGFVKGSEWVEPLPDGFLGERGRIVKSVPQQEVLAHGAIGAFWTHGGWNGTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 1291 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctaccggttcaacttcctgaagaatccgggtgtagaatttccgtttccggcgatcaacctgccgaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 1292 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYRFNFLKNPGVEFPFPAINLPKVEQVKMREMFEKEPNEEDRLAEGNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 1293 - DNA, 1353 bp, Artificial Sequence
  ADP-Glycosyltransferase Variant of SEQ ID NO: 770
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcatcatcaagaagatcccggagaaatacagtgagagcatccattttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatcaacctgccgaaggtggaacaggtgaagatgcgcgagatgtttgaaaaggagccgaacgaagaagatcgcttagcagaacataatatgcagatcatgctgatgtgcacgagccgcaccattgaggctaagtacctggactattgcaccgaactgagcaattggaaagttgttccggttggtccgccatttcaggacccgattactaatgatgcggacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagccttgattttggcgttccgatcattgcgatgccgatgcacaacgatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaag

SEQ ID NO: 1294 - protein, 451 aa, Artificial Sequence
  ADP-Glycosyltransferase Variant of SEQ ID NO: 770
MHHHHHHGGSGATLRVLMFPWLAYGHISPFLNIAKQLADRGFLIYLCSTLINLESIIKKIPEKYSESIHFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAINLPKVEQVKMREMFEKEPNEEDRLAEHNMQIMLMCTSRTIEAKYLDYCTELSNWKVVPVGPPFQDPITNDADDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAVEIVRDDDGNIHRGEIAETLKDVITGETGEILRGKVRDISKNLKSIREEEMNAAAEELIQLCRNSNKYK

SEQ ID NO: 1295 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1296 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1297 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1298 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1299 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1300 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEAIFRDPWMVFAWRPRPGVWEYVRIHVEQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1301 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctagatcgcgaatcacaggtcatggaacgctatctggaaatgttccgccacctgcaatggcgcccgctggctcatgccgtaccgatggag

SEQ ID NO: 1302 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1303 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgcgaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcagtggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1304 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLAVEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLQWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1305 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1306 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1307 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgacgcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1308 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDAPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1309 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1310 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1311 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1312 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEAIFRDPWMVFAWRPRPGVWEYVRIHREQLALEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1313 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1314 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1315 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccgtggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1316 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLAVEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1317 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctggaagtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccggatccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1318 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLAVEELSTDEYLQAKEGLVGLGAEGEAVLEVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPDPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1319 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1320 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLAVEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1321 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgcgaacagctggccctggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgacgcgccggatccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1322 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDAPDPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1323 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctggaagtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1324 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLALEELSTDEYLQAKEGLVGLGAEGEAVLEVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1325 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgcttctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1326 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLAVEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1327 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccggatccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1328 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLAVEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPDPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1329 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgcgaacagctggccgtggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1330 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLAVEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1331 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1332 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1333 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccggatccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1334 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPDPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1335 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccggatccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1336 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLALEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPDPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1337 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1338 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEAIFRDPWMVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLEMFRHLQWRPLAHAVPME

SEQ ID NO: 1339 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctggaagtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1340 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDEYLQAKEGLVGLGAEGEAVLEVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1341 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctggaagtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgacgcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1342 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLAVEELSTDEYLQAKEGLVGLGAEGEAVLEVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDAPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1343 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1344 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEAIFRDPWMVFAWRPRPGVWEYVRIHREQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1345 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1346 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1347 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttcgaagattttcgtccggttagccgccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1348 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEAIFRDPWMVFAWRPRPGVWEYVRIHREQLALEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1349 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatgggacgctatctggaaatgttccgccacctgcaatggcgcccgctggctcatgccgtaccgatggag

SEQ ID NO: 1350 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFRDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMGRYLEMFRHLQWRPLAHAVPME

SEQ ID NO: 1351 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgcgattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1352 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1353 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccggatccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1354 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPDPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1355 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgacgcgccggatccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1356 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDAPDPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1357 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1358 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1359 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1360 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1361 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1362 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1363 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1364 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1365 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgcgaacagctggccgtggaggagctgagcactgatgaatatctacaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1366 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLAVEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1367 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1368 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1369 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcagagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1370 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGQSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1371 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1372 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHREQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1373 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttcgaagattttcgtccggttagccgccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1374 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1375 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1376 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLALEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1377 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgacgcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1378 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDAPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1379 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1380 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEAIFRDPWMVFAWRPRPGVWEYVRIHREQLALEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPWLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1381 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgcgattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1382 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLEMFRHLQWRPLAHAVPME

SEQ ID NO: 1383 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgcgaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactcgccgtccccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctggaaatgttccgccacctgcaatggcgcccgctggctcatgccgtaccgatggag

SEQ ID NO: 1384 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHREQLAVEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLEMFRHLQWRPLAHAVPME

SEQ ID NO: 1385 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatcgtgaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1386 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEAIFRDPWMVFAWRPRPGVWEYVRIHREQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1387 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaagatttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgcgatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1388 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKIWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1389 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcatccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatcgcgaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgacgcgccggatccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcccgatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggcgggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1390 - protein, 793 aa, Artificial Sequence
  Variant of Sucrose Synthase
MIEELRQQLLDDPRSWYAFLRHLVASQRDSWLQTDLQRACADFREQHPEGYDEGIGPLEDFVAHTQEVIFRDPWMVFAWRPRPGVWEYVRIHREQLALEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDAPDPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYAQDLEREVLAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARVFGFWRFVLDRESQVMERYLQMFRHLQWRPLAHAVPME

SEQ ID NO: 1391 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1392 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1393 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcagttagcaggccgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1394 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRQLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1395 - DNA, 2379 bp, Artificial Sequence
  Variant of Sucrose Synthase
atgattgaagaactgcgccaacagctgctggatgatccgcgttcatggtacgcattcctgcgtcatctagtcgcatctcagcgtgactcatggttacagacggatttacagcgcgcgtgcgcggattttcgcgaacagcttccggaaggctatgatgaagatattggtccgctcgaagattttgtggcacatacccaggaagtgatcttccgtgatccgtggatggtttttgcgtggcgtccacgtccaggtgtttgggaatatgtgcgcattcatgtagaacagctggtgctggaggagctgagcactgatgaatatctgcaagccaaagaaggccttgttggcttaggtaatgaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtgaacgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcacgaacaggaccatcactttgcgtgtcagtttaccgcggatctgatcgcgatgaatgcagcagacatcatcgtgacgagcacataccaggaaattgcaggtaacgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcccgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacaacgttagcggcttccatattgatcccaacgaccatgaagcgaccgcagaacggctggccgacttcctggaagcagcgcgtgaacgtccgcactattgggaagaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1396 - protein, 793 aa, Artificial Sequence
  Variant of Sucrose Synthase
MIEELRQQLLDDPRSWYAFLRHLVASQRDSWLQTDLQRACADFREQLPEGYDEDIGPLEDFVAHTQEVIFRDPWMVFAWRPRPGVWEYVRIHVEQLVLEELSTDEYLQAKEGLVGLGNEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRERLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDNVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1397 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggtgctggaggagctgagcactgatgaatatctgcaagccaaagaaggccttgttggcttaggtaatgaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggaaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaatcgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggataacgaacaggaccatcactttgcgtgtcagtttaccgcggatctgatcgcgatgaatgcagcagacatcatcgtgacgagcacataccaggaaattgcaggtaacgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcccgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacaacgttagcggcttccatattgatcccaacgaccatgaagcgaccgcagaacggctggccgacttcctggaagcagcgcgtgaacgtccgcactattgggaagaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1398 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLVLEELSTDEYLQAKEGLVGLGNEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDNEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDNVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1399 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgctttgttctggatcgcgaatcacaggtcatggaacgctatctgcaaatgttccgccacctgcaatggcgcccgctggctcatgccgtaccgatggag

SEQ ID NO: 1400 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRHGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1401 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcacccttccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgctttgttctggatcgcgaatcacaggtcatggaacgctatctgcaaatgttccgccacctgcaatggcgcccgctggctcatgccgtaccgatggag

SEQ ID NO: 1402 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRHGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1403 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgcaaggaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacatattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1404 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRKEDGRIHPHWISRFKVWPYLERYAQDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRHGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1405 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcacccttccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgcaaggaggatggtcgtattcaccggcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacatattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgctttgttctggatcgcgaatcacaggtcatggaacgctatctgcaaatgttccgccacctgcaatggcgcccgctggctcatgccgtaccgatggag

SEQ ID NO: 1406 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRKEDGRIHRHWISRFKVWPYLERYAQDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRHGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1407 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcggccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagacccacgcttttattttagctatgcacgtactgaagaacgcccatcgtctctggagccagaaatcgaaagtctgctgtttggccgcgaaccaggtgcagatatacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1408 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADIRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1409 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1410 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1411 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtggacaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1412 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVDNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1413 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1414 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFRDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1415 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1416 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1417 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1418 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1419 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1420 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1421 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1422 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1423 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1424 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1425 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1426 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1427 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1428 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1429 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1430 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1431 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1432 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFRDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1433 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1434 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1435 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1436 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1437 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1438 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1439 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1440 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1441 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacttcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1442 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADFIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1443 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1444 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1445 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1446 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1447 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1448 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1449 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1450 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

(The sequence listing continues in the following parts.)

We claim:

1. An engineered sucrose synthase comprising a polypeptide sequence having at least 90% sequence identity to SEQ ID NO:74 and having sucrose synthase activity, wherein the polypeptide sequence comprises the mutation set 4/33/47/52/343/532, wherein positions of the set are numbered with reference to SEQ ID NO:74.

2. The engineered sucrose synthase of claim 1, wherein said polypeptide sequence of said engineered sucrose synthase further comprises at least one mutation or mutation set at one or more positions selected from 4/9/349/532, 4/13/113/343/532, 4/13/113/532, 4/47/52/532, 4/113/532, 4/13/113, 4/13/532, 4/33/113, 7, 8, 44, 95, 117/440, 136, 221, 343/532, 440, 444, 478, 532, 583, 611, 615, 615/789, 695, 722, and 788, wherein said positions are numbered with reference to SEQ ID NO:74.

3. A composition comprising at least one engineered sucrose synthase of claim 1.

4. A method for glycosylation of a substrate comprising providing at least one substrate, at least one engineered glycosyltransferase, and the sucrose synthase of claim 1, and contacting said substrate with said glycosyltransferase and sucrose synthase under conditions such that said substrate is glycosylated to produce at least one glycosylated product.

5. The method of claim 4, wherein said glycosylated product comprises rebaudioside M, wherein said substrate comprises rebaudioside D and/or rebaudioside I, and further comprising providing NDP-glucose.

6. The method of claim 4, wherein said glycosylated product comprises rebaudioside A and/or rebaudioside I, wherein said substrate comprises at least one stevioside substrate, and further comprising providing NDP-glucose.

7. The method of claim 4, wherein said glycosylated product comprises rebaudioside D, wherein said substrate comprises at least one stevioside substrate, and further comprising providing NDP-glucose.

8. The method of claim 5, wherein said NDP-glucose is selected from ADP-glucose, CDP-glucose, TDP-glucose, GDP-glucose, and/or IDT-glucose.

* * * * *